(12) United States Patent
Oakes et al.

(10) Patent No.: US 11,613,742 B2
(45) Date of Patent: *Mar. 28, 2023

(54) COMPOSITIONS AND METHODS FOR THE TARGETING OF SOD1

(71) Applicant: Scribe Therapeutics Inc., Alameda, CA (US)

(72) Inventors: Benjamin Oakes, El Cerrito, CA (US); Sean Higgins, Alameda, CA (US); Hannah Spinner, Boston, MA (US); Sarah Denny, San Francisco, CA (US); Brett T. Staahl, Tiburon, CA (US); Kian Taylor, Atlanta, GA (US); Katherine Baney, Berkeley, CA (US); Isabel Colin, Oakland, CA (US); Maroof Adil, Davis, CA (US); Cole Urnes, Los Angeles, CA (US)

(73) Assignee: SCRIBE THERAPEUTICS INC., Alameda, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/483,692

(22) Filed: Sep. 23, 2021

(65) Prior Publication Data

US 2022/0090036 A1 Mar. 24, 2022

Related U.S. Application Data

(63) Continuation of application No. PCT/US2020/050000, filed on Sep. 9, 2020.

(60) Provisional application No. 63/074,375, filed on Sep. 3, 2020, provisional application No. 62/945,138, filed on Dec. 7, 2019, provisional application No. 62/897,941, filed on Sep. 9, 2019.

(51) Int. Cl.
| | | |
|---|---|---|
| *C12N 9/22* | (2006.01) | |
| *C12N 15/11* | (2006.01) | |
| *C12N 15/86* | (2006.01) | |
| *C12N 15/90* | (2006.01) | |
| *A61P 25/28* | (2006.01) | |
| *C12N 9/06* | (2006.01) | |
| *C12N 15/10* | (2006.01) | |
| *C12N 15/113* | (2010.01) | |

(52) U.S. Cl.
CPC .............. *C12N 9/22* (2013.01); *A61P 25/28* (2018.01); *C12N 9/003* (2013.01); *C12N 15/101* (2013.01); *C12N 15/1051* (2013.01); *C12N 15/11* (2013.01); *C12N 15/1133* (2013.01); *C12N 15/86* (2013.01); *C12N 15/907* (2013.01); *C12N 2310/20* (2017.05); *C12N 2750/14143* (2013.01)

(58) Field of Classification Search
CPC .... C12N 15/11; C12N 15/907; C12N 15/102; C12N 15/1137; C12N 15/111; C12N 2310/20

See application file for complete search history.

(56) References Cited

U.S. PATENT DOCUMENTS

| | | |
|---|---|---|
| 5,173,414 A | 12/1992 | Lebkowski et al. |
| 5,405,733 A | 4/1995 | Pirrung et al. |
| 5,412,087 A | 5/1995 | Mcgall et al. |
| 5,445,934 A | 8/1995 | Fodor et al. |
| 5,695,937 A | 12/1997 | Kinzler et al. |
| 10,369,232 B2 | 8/2019 | Chivukula et al. |
| 11,174,469 B2 | 11/2021 | Lundberg et al. |
| 2015/0301028 A1* | 10/2015 | Eggan ................ G01N 33/6872 435/29 |
| 2017/0369870 A1 | 12/2017 | Gill et al. |
| 2018/0148711 A1 | 5/2018 | Finer et al. |
| 2018/0258424 A1 | 9/2018 | Greenberg et al. |
| 2019/0330603 A1 | 10/2019 | Ahlfors et al. |
| 2022/0081681 A1 | 3/2022 | Oakes et al. |
| 2022/0220508 A1 | 7/2022 | Oakes et al. |

FOREIGN PATENT DOCUMENTS

| | | | |
|---|---|---|---|
| WO | WO-2010/075303 A1 | 7/2010 | |
| WO | WO-2012/068627 A1 | 5/2012 | |
| WO | WO-2017/068077 A1 | 4/2017 | |
| WO | WO-2017216771 A2 * | 12/2017 | .............. A61P 35/00 |
| WO | WO-2018/002762 A1 | 1/2018 | |
| WO | WO-2018/027078 A1 | 2/2018 | |
| WO | WO-2018/064371 A1 | 4/2018 | |
| WO | WO-2018/195555 A1 | 10/2018 | |
| WO | WO-2018/220211 A1 | 12/2018 | |
| WO | WO-2019/051278 A1 | 3/2019 | |

(Continued)

OTHER PUBLICATIONS

Yin et al. Partial DNA-guided Cas9 enables genome editing with reduced off-target activity. Nature Chemical Biology, vol. 14, pp. 311-316, p. 1/1 of Online Methods, and pp. 1/14-14/14 of Supplementary Information, Jan. 29, 2018. (Year: 2018).*

(Continued)

*Primary Examiner* — Jennifer Dunston
(74) *Attorney, Agent, or Firm* — Cooley LLP

(57) ABSTRACT

Provided herein are CasX:gNA systems comprising CasX polypeptides, guide nucleic acids (gNA), and optionally donor template nucleic acids useful in the modification of a SOD1 gene. The systems are also useful for introduction into cells, for example eukaryotic cells having mutations in the SOD1 protein or the SOD1 regulatory element. Also provided are methods of using such CasX:gNA systems to modify cells having such mutations and utility in methods of treatment of a subject with a SOD1-related disease.

25 Claims, 102 Drawing Sheets

Specification includes a Sequence Listing.

(56) References Cited

FOREIGN PATENT DOCUMENTS

| WO | WO-2020/023529 A1 | 1/2020 |
|---|---|---|
| WO | WO-2020/041456 A1 | 2/2020 |
| WO | WO-2020/168075 A1 | 8/2020 |
| WO | WO-2020/247882 A1 | 12/2020 |

OTHER PUBLICATIONS

Moon et al. Improving CRISPR genome editing by engineering guide RNAs. Trends in Biotechnology, vol. 37, No. 8, pp. 870-881, Mar. 4, 2019. (Year: 2019).*
Fowler et al. Measuring the activity of protein variants on a large scale using deep mutational scanning. Nature Protocols, vol. 9, No. 9, pp. 2267-2284, 2014. (Year: 2014).*
Kiskinis et al. Pathways disrupted in human ALS motor neurons identified through genetic correction of mutant SOD1. Cell Stem Cell, vol. 14, pp. 781-795, Jun. 5, 2014. (Year: 2014).*
Deng et al. Amytrophic Lateral Sclerosis and structural defects in Cu, Zn superoxide dismutase. Science, vol. 261, pp. 1047-1051, Aug. 20, 1993. (Year: 1993).*
Aguilera, T.A. et al. (Jun. 2009). "Systemic in vivo distribution of activatable cell penetrating peptides is superior to that of cell penetrating peptides," Inegr. Bio. (Camb) 1(5-6):371-381. Published online May 11, 2009.
Aitschul, S.F. et al. (1990). "Basic local alignment search tool," J. Mol. Biol. 215:403-410.
Andersen, P.M. et al. (1995). "Amyotrophic lateral sclerosis associated with homozygosity for an ASp90Ala mutation in CuZn-superoxide dismutase," Nat. Genet. 10:61-66.
Baskoylu, S.N. et al. (2018). "Single copy/knock-n models of ALS SOD1 in *C. elegans* suggest loss and gain of function have different contributions to cholinergic and glutamatergic neurodegeneration," PLoS Genet. 14:e1007682.
Bhinge, A. et al. (2017). "Genetic Correction of SOD1 Mutant iPSCs Reveals ERK and JNK Activated API as a Driver of Neurodegeneration in Amyotrophic Lateral Sclerosis," Stem Cell Reports 8:856-869.
Bunton-Stasyshyn et al. (2015). "SODI Function and Its Implications for Amyotrophic Lateral Sclerosis Pathology: New and Renascent Themes," Neuroscientist 21:519-529.
Burstein, D. et al. (Feb. 2017), "New CRISPR-Cas systems from uncultivated microbes," Nature 542:237-241. Published online Dec. 22, 2016, with Supplemental Materials, 28 total pages.
Chen, B. et al. (2003). "Influence of histidine on the stability and physical properties of a fully human antibody in aqueous and solid forms," Pharm. Res. 20:1952-1960.
Dirren, E. et al. (2015). "SOD1 silencing in motoneurons or glia rescues neuromuscular function in ALS mice," Ann. Clin. Transl. Neurol. 2:167-184.
Forsberg et al. (2011). "Glial nuclear aggregates of superoxide dismutase-1 are regularly present in patients with amyotrophic lateral sclerosis," Acta Neuropathol. 121:623-634.
Foust, K.D. et al. (2013). "Therapeutic AAV9-mediated Suppression of Mutant SOD1 Slows Disease Progression and Extends Survival in Models of inherited ALS," Mol. Ther. 21:2148-2159.
Fox, L.M. et al. (2015). "Chapter 7: Macroautophagy of aggregating-prone proteins of neurodegenerative disease," Autophagy: Cancer, Other Pathologies, Inflammation, Immunity, Infection, and Aging, Academic Press, M. A. Hayat, Editor, pp. 117-137.
Gaj et al. (2017). "in vivo genome editing improves motor function and extends survival in a mouse model of ALS," Science 3:3952, 10 pages.
Ghirlando, R. et al. (1999). "Glycosylation of human IgG-Fc: influences on structure revealed by differential scanning microcalorimetry," Immunol Letters 68:47-52.
Gurey, M.E. et al. (1994). "Motor neuron degeneration in mice that express a human Cu,Zn 38 superoxide dismutase mutation," Science 264:1772-1775.

Hermonat, P.L. et al. (1984). "Use of adeno-associated virus as a mammalian DNA cloning vector: Transduction of neomycin resistance into mammalian tissue culture cells," PNAS 81:6466-6470.
Imamura, K. et al. (2017). "The Src/c-Abl pathway is a potential therapeutic target 40 in amyotrophic lateral sclerosis," Sci. Transl. Med. 9:eaaf3962, 10 pages.
International Search Report dated Feb. 17. 2021. for PCT Application No. PCT/US2020/050000, filed on Sep. 9, 2020, 8 pages.
Kiernan, M. et al. (2011). "Amyotrophic lateral sclerosis," Lancet 377:942-955.
Kotin, R.M. (1994). "Prospects for the use of adeno-associated virus as a vector for human gene therapy," Human Gene Therapy 5:793-801.
Kruminis-Kaszkiel, E. et al. (2018). "CRISPR/Cas9 Technology as an Emerging Tool for Targeting Amyotrophic Lateral Sclerosis (ALS)," Int. J. Mol. Sci. 19:906, 13 pages.
Kunkel, G.R. et al. (1986). "U6 small nuclear RNA is transcribed by RNA polymerase III," PNAS 83:8575-8579.
Lee, H. et al. (2017). "Assay development for high content qualification of SOD1 mutant protein aggregate formation in living cells," J. Vis. Exp. 128:56425, 13 total pages.
Liu, J.J. et al. "CasX enzymes comprise a distinct family of RNA-guided genome editors," Nature 566:218-223. Published online Feb. 4, 2019, 38 pages.
Liu, J.J. et al. "CasX enzymes comprise a distinct family of RNA-guided genome editors," Nature 48 568:E8-E10. (Author correction: published online Apr. 3, 2019).
Murray, A. et al. (2002). "Epitope Affinity Chromatography and Biophysical Studies of Monoclonal 49 Antibodies and Recombinant Antibody Fragments," J. Chromatogr Sci 40:343-349.
Niwa, J-I. et al. (2007). "Disulfide bond mediates aggregation, toxicity, and ubiquitylation of familial 50 amyotrophic lateral sclerosis-linked mutant SOD1," Biol. Chem. 282:28087-28095.
Noguchi, H. et. al. (Jul. 2003), "PDX-1 protein containing its own antennapedia-like protein transduction domain can transduce pancreatic duct and islet cells," Diabetes 52:1732-1737.
Pardo, C.A. et al. (1995). "Superoxide dismutase is an abundant, component in cell bodies, dendrites, and axons of motor neurons and in a subset of other neurons," PNAS 92:954-958.
Petrov D. et al. (2017). "ALS Clinical Trials Review: 20 Years of Failure. Are We Any Closer to Registering a New Treatment?" Front Aging Neurosci. 9:68, 11 pages.
Philips, T. et al. (2015). "Rodent models of amyotrophic lateral sclerosis," Curr. Protoc. Pharmacol. 54, 69:5.67.1-5.67.21.
Pochet, R. (2017). "Genetics and ALS: Cause for Optimism," Cerebrum 2017:cer-05-17, 13 pages.
Qi, L.S. et al. (Feb. 2013). "Repurposing CRISPR as an RNA-guided platform for sequence-specific control of gene expression," Cell 152:1173-1183, 22 pages.
Sakeilariou, G.K, et al. (2018). "Comparison of Whole Body SOD1 Knockout with Muscle-Specific SOD1 Knockout Mice Reveals a Role for Nerve Redox Signaling in Regulation of Degenerative Pathways in Skeletal Muscle," Antioxid Redox Signal 28:275-295.
Samulski, R.J. et al. (1989). "Helper-Free Stocks of Recombinant Adeno-Associated Viruses: Normal Integration Does Not Require Viral Gene Expression," J. Virol. 63:3822-3828.
Sharma, A. et al. (2016). "ALS-associated mutant FUS induces selective motor neuron gegeneration through toxic gain of function," Nat. Commun. 7:10465, 14 pages.
Sherman et al. (1983). "Nucleotide sequence and expression of human chromosome 21-encoded superoxide dismutase mRNA," PNAS 80:5465-5469.
Smith, T.F. et al. (1981). "Comparison of biosequences," Adv. Appl. Math. 2:482-489. Published online Sep. 3, 2004.
Stevens, J.C. et al. (2010). "Modification of superoxide Dismutase 1 (SOD1) Properties by a GFP Tag-Implications for Research into amyotrophic lateral sclerosis (ALS)," PLoS One 5:e9541. 10 pages.
Stolca, L. et al. (2016). "AAV delivered artificial microRNA extends survival and delays paralysis in an Amyotrophic Lateral Sclerosis mouse model," Ann. Neurol. 79:687-700, 24 pages.
Tratschin, J-D. et al., (1985). "Adeno-Associated Virus Vector for High-Frequency Integration, Expression, and Rescue of Genes in Mammalian Ceils," Mol. Cell. Biol. 5:3251-3260.

(56) References Cited

OTHER PUBLICATIONS

Tratschin, J-D. et al. (1984). "A Human Parvovirus, Adeno-Associated Virus, as a Eucaryotic Vector: Transient Expression and Encapsidation of the Procaryotic Gene for Chloramphenicol Acetyltransferase," Mol. Cell. Biol. 4:2072-2081.

Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.

Wang, L. et al. (2017). "CRISPR/Casg-mediated targeted gene correction in amyotrophic lateral sclerosis palter iPSCs," Protein Cell. 8:365-378.

Wender, P.A. et al. (Nov. 2000). "The design, synthesis, arsd evaluation of molecules that enable or enhance cellular uptake: peptoid molecular transporters," PNAS 97:13003-13008.

Written Opinion of the International Searching Authority dated Feb. 17, 2021, for PCT Application No. PCT/US2020/050000, filed on Sep. 9, 2020, 12 pages.

Yang, H. et al. (May 2019). "CasX: a new and small CRISPR gene-editing protein," Cell Res. 29:345-346. Published online Apr. 16, 2019.

Zender, L. et al, (Jun. 2002). "VP22-mediated intercellular transport of p53 in hepatoma ceils in vitro and in vivo," Cancer Gene Ther. 9:489-496.

Zhang, J. et al. (Jun. 1997). "PowerBLAST: a new network BLAST application for interactive or automated sequence analysis and annotation," Genome Res. 7:649-656.

\* cited by examiner

Endogenous Reporter line generation

FIG. 33: Table 3 - gNA Targeting Sequences for the SOD1 Gene

| Construct | SEQ ID NO | Construct | SEQ ID NO | Construct | SEQ ID NO | Construct | SEQ ID NO |
|---|---|---|---|---|---|---|---|
| TTCN_0 | 372 | CTCN_1940 | 6525 | CTCN_17 | 412 | TTCN_1783 | 6565 |
| TTCN_1 | 373 | TTCN_1766 | 6526 | ATCN_5 | 413 | ATCN_1235 | 6566 |
| GTCN_0 | 374 | TTCN_1767 | 6527 | GTCN_3 | 414 | ATCN_1236 | 6567 |
| ATCN_1 | 375 | TTCN_1768 | 6528 | ATCN_6 | 415 | TTCN_1784 | 6568 |
| TTCN_2 | 376 | GTCN_1041 | 6529 | CTCN_18 | 416 | TTCN_1785 | 6569 |
| CTCN_0 | 377 | GTCN_1042 | 6530 | TTCN_16 | 417 | CTCN_1947 | 6570 |
| ATCN_2 | 378 | ATCN_1227 | 6531 | CTCN_19 | 418 | GTCN_1049 | 6571 |
| TTCN_3 | 379 | TTCN_1769 | 6532 | TTCN_17 | 419 | TTCN_1786 | 6572 |
| GTCN_1 | 380 | TTCN_1770 | 6533 | TTCN_18 | 420 | TTCN_1787 | 6573 |
| ATCN_3 | 381 | TTCN_1771 | 6534 | ATCN_7 | 421 | CTCN_1948 | 6574 |
| TTCN_4 | 382 | TTCN_1772 | 6535 | TTCN_19 | 422 | TTCN_1788 | 6575 |
| TTCN_5 | 383 | GTCN_1043 | 6536 | GTCN_4 | 423 | GTCN_1050 | 6576 |
| ATCN_4 | 384 | TTCN_1773 | 6537 | GTCN_5 | 424 | CTCN_1949 | 6577 |
| CTCN_1 | 385 | GTCN_1044 | 6538 | ATCN_8 | 425 | GTCN_1051 | 6578 |
| CTCN_2 | 386 | ATCN_1228 | 6539 | CTCN_20 | 426 | CTCN_1950 | 6579 |
| TTCN_6 | 387 | ATCN_1229 | 6540 | GTCN_6 | 427 | TTCN_1789 | 6580 |
| TTCN_7 | 388 | ATCN_1230 | 6541 | TTCN_20 | 428 | ATCN_1237 | 6581 |
| CTCN_3 | 389 | TTCN_1774 | 6542 | TTCN_21 | 429 | ATCN_1238 | 6582 |
| CTCN_4 | 390 | TTCN_1775 | 6543 | ATCN_9 | 430 | ATCN_1239 | 6583 |
| CTCN_5 | 391 | TTCN_1776 | 6544 | ATCN_10 | 431 | ATCN_1240 | 6584 |
| CTCN_6 | 392 | ATCN_1231 | 6545 | TTCN_22 | 432 | ATCN_1241 | 6585 |
| CTCN_7 | 393 | ATCN_1232 | 6546 | GTCN_7 | 433 | TTCN_1790 | 6586 |
| TTCN_8 | 394 | TTCN_1777 | 6547 | ATCN_11 | 434 | CTCN_1951 | 6587 |
| CTCN_8 | 395 | GTCN_1045 | 6548 | ATCN_12 | 435 | GTCN_1052 | 6588 |
| CTCN_9 | 396 | CTCN_1941 | 6549 | CTCN_21 | 436 | GTCN_1053 | 6589 |
| CTCN_10 | 397 | GTCN_1046 | 6550 | ATCN_13 | 437 | GTCN_1054 | 6590 |
| CTCN_11 | 398 | CTCN_1942 | 6551 | CTCN_22 | 438 | ATCN_1242 | 6591 |
| CTCN_12 | 399 | TTCN_1778 | 6552 | GTCN_8 | 439 | ATCN_1243 | 6592 |
| CTCN_13 | 400 | TTCN_1779 | 6553 | CTCN_23 | 440 | GTCN_1055 | 6593 |
| CTCN_14 | 401 | TTCN_1780 | 6554 | TTCN_23 | 441 | TTCN_1791 | 6594 |
| CTCN_15 | 402 | TTCN_1781 | 6555 | TTCN_24 | 442 | ATCN_1244 | 6595 |
| CTCN_16 | 403 | GTCN_1047 | 6556 | ATCN_14 | 443 | TTCN_1792 | 6596 |
| TTCN_9 | 404 | ATCN_1233 | 6557 | GTCN_9 | 444 | ATCN_1245 | 6597 |
| TTCN_10 | 405 | ATCN_1234 | 6558 | GTCN_10 | 445 | ATCN_1246 | 6598 |
| TTCN_11 | 406 | CTCN_1943 | 6559 | ATCN_15 | 446 | CTCN_1952 | 6599 |
| TTCN_12 | 407 | GTCN_1048 | 6560 | GTCN_11 | 447 | CTCN_1953 | 6600 |
| TTCN_13 | 408 | CTCN_1944 | 6561 | ATCN_16 | 448 | CTCN_1954 | 6601 |
| TTCN_14 | 409 | CTCN_1945 | 6562 | CTCN_24 | 449 | CTCN_1955 | 6602 |
| TTCN_15 | 410 | CTCN_1946 | 6563 | TTCN_25 | 450 | GTCN_1056 | 6603 |
| GTCN_2 | 411 | TTCN_1782 | 6564 | GTCN_12 | 451 | ATCN_1247 | 6604 |
|  |  |  |  | TTCN_26 | 452 | TTCN_1793 | 6605 |
|  |  |  |  | GTCN_13 | 453 | ATCN_1248 | 6606 |

FIG. 33 (continued)

| | | | | | | | |
|---|---|---|---|---|---|---|---|
| CTCN_25 | 454 | TTCN_1794 | 6607 | GTCN_24 | 497 | GTCN_1065 | 6650 |
| GTCN_14 | 455 | TTCN_1795 | 6608 | CTCN_38 | 498 | TTCN_1814 | 6651 |
| CTCN_26 | 456 | GTCN_1057 | 6609 | TTCN_40 | 499 | GTCN_1066 | 6652 |
| ATCN_17 | 457 | ATCN_1249 | 6610 | CTCN_39 | 500 | ATCN_1262 | 6653 |
| GTCN_15 | 458 | TTCN_1796 | 6611 | CTCN_40 | 501 | TTCN_1815 | 6654 |
| CTCN_27 | 459 | ATCN_1250 | 6612 | CTCN_41 | 502 | ATCN_1263 | 6655 |
| GTCN_16 | 460 | GTCN_1058 | 6613 | TTCN_41 | 503 | TTCN_1816 | 6656 |
| ATCN_18 | 461 | TTCN_1797 | 6614 | TTCN_42 | 504 | GTCN_1067 | 6657 |
| CTCN_28 | 462 | ATCN_1251 | 6615 | GTCN_25 | 505 | CTCN_1958 | 6658 |
| GTCN_17 | 463 | ATCN_1252 | 6616 | TTCN_43 | 506 | CTCN_1959 | 6659 |
| TTCN_27 | 464 | ATCN_1253 | 6617 | ATCN_24 | 507 | CTCN_1960 | 6660 |
| CTCN_29 | 465 | TTCN_1798 | 6618 | CTCN_42 | 508 | CTCN_1961 | 6661 |
| TTCN_28 | 466 | TTCN_1799 | 6619 | TTCN_44 | 509 | TTCN_1817 | 6662 |
| ATCN_19 | 467 | GTCN_1059 | 6620 | TTCN_45 | 510 | GTCN_1068 | 6663 |
| TTCN_29 | 468 | TTCN_1800 | 6621 | ATCN_25 | 511 | TTCN_1818 | 6664 |
| GTCN_18 | 469 | TTCN_1801 | 6622 | TTCN_46 | 512 | TTCN_1819 | 6665 |
| TTCN_30 | 470 | ATCN_1254 | 6623 | CTCN_43 | 513 | TTCN_1820 | 6666 |
| CTCN_30 | 471 | GTCN_1060 | 6624 | GTCN_26 | 514 | CTCN_1962 | 6667 |
| TTCN_31 | 472 | TTCN_1802 | 6625 | GTCN_27 | 515 | TTCN_1821 | 6668 |
| ATCN_20 | 473 | TTCN_1803 | 6626 | GTCN_28 | 516 | ATCN_1264 | 6669 |
| TTCN_32 | 474 | ATCN_1255 | 6627 | CTCN_44 | 517 | TTCN_1822 | 6670 |
| CTCN_31 | 475 | GTCN_1061 | 6628 | TTCN_47 | 518 | TTCN_1823 | 6671 |
| TTCN_33 | 476 | ATCN_1256 | 6629 | ATCN_26 | 519 | ATCN_1265 | 6672 |
| CTCN_32 | 477 | ATCN_1257 | 6630 | GTCN_29 | 520 | ATCN_1266 | 6673 |
| GTCN_19 | 478 | CTCN_1956 | 6631 | GTCN_30 | 521 | GTCN_1069 | 6674 |
| GTCN_20 | 479 | TTCN_1804 | 6632 | CTCN_45 | 522 | TTCN_1824 | 6675 |
| TTCN_34 | 480 | TTCN_1805 | 6633 | ATCN_27 | 523 | TTCN_1825 | 6676 |
| TTCN_35 | 481 | GTCN_1062 | 6634 | ATCN_28 | 524 | CTCN_1963 | 6677 |
| TTCN_36 | 482 | ATCN_1258 | 6635 | ATCN_29 | 525 | TTCN_1826 | 6678 |
| ATCN_21 | 483 | TTCN_1806 | 6636 | GTCN_31 | 526 | TTCN_1827 | 6679 |
| CTCN_33 | 484 | ATCN_1259 | 6637 | CTCN_46 | 527 | TTCN_1828 | 6680 |
| CTCN_34 | 485 | TTCN_1807 | 6638 | CTCN_47 | 528 | TTCN_1829 | 6681 |
| ATCN_22 | 486 | CTCN_1957 | 6639 | TTCN_48 | 529 | CTCN_1964 | 6682 |
| CTCN_35 | 487 | TTCN_1808 | 6640 | CTCN_48 | 530 | GTCN_1070 | 6683 |
| TTCN_37 | 488 | ATCN_1260 | 6641 | TTCN_49 | 531 | TTCN_1830 | 6684 |
| ATCN_23 | 489 | GTCN_1063 | 6642 | TTCN_50 | 532 | CTCN_1965 | 6685 |
| GTCN_21 | 490 | TTCN_1809 | 6643 | TTCN_51 | 533 | ATCN_1267 | 6686 |
| TTCN_38 | 491 | TTCN_1810 | 6644 | CTCN_49 | 534 | GTCN_1071 | 6687 |
| CTCN_36 | 492 | TTCN_1811 | 6645 | TTCN_52 | 535 | TTCN_1831 | 6688 |
| TTCN_39 | 493 | TTCN_1812 | 6646 | TTCN_53 | 536 | GTCN_1072 | 6689 |
| CTCN_37 | 494 | TTCN_1813 | 6647 | TTCN_54 | 537 | GTCN_1073 | 6690 |
| GTCN_22 | 495 | GTCN_1064 | 6648 | CTCN_50 | 538 | TTCN_1832 | 6691 |
| GTCN_23 | 496 | ATCN_1261 | 6649 | TTCN_55 | 539 | CTCN_1966 | 6692 |

FIG. 33 (continued)

| | | | | | | | |
|---|---|---|---|---|---|---|---|
| CTCN_51 | 540 | TTCN_1833 | 6693 | ATCN_39 | 583 | TTCN_1846 | 6736 |
| CTCN_52 | 541 | ATCN_1268 | 6694 | ATCN_40 | 584 | ATCN_1282 | 6737 |
| CTCN_53 | 542 | CTCN_1967 | 6695 | ATCN_41 | 585 | ATCN_1283 | 6738 |
| CTCN_54 | 543 | CTCN_1968 | 6696 | CTCN_72 | 586 | ATCN_1284 | 6739 |
| TTCN_56 | 544 | ATCN_1269 | 6697 | CTCN_73 | 587 | TTCN_1847 | 6740 |
| CTCN_55 | 545 | TTCN_1834 | 6698 | TTCN_63 | 588 | ATCN_1285 | 6741 |
| GTCN_32 | 546 | CTCN_1969 | 6699 | CTCN_74 | 589 | CTCN_1976 | 6742 |
| CTCN_56 | 547 | TTCN_1835 | 6700 | ATCN_42 | 590 | GTCN_1081 | 6743 |
| ATCN_30 | 548 | ATCN_1270 | 6701 | ATCN_43 | 591 | TTCN_1848 | 6744 |
| ATCN_31 | 549 | CTCN_1970 | 6702 | CTCN_75 | 592 | GTCN_1082 | 6745 |
| CTCN_57 | 550 | CTCN_1971 | 6703 | TTCN_64 | 593 | GTCN_1083 | 6746 |
| CTCN_58 | 551 | ATCN_1271 | 6704 | CTCN_76 | 594 | ATCN_1286 | 6747 |
| CTCN_59 | 552 | GTCN_1074 | 6705 | GTCN_38 | 595 | ATCN_1287 | 6748 |
| TTCN_57 | 553 | ATCN_1272 | 6706 | CTCN_77 | 596 | GTCN_1084 | 6749 |
| TTCN_58 | 554 | TTCN_1836 | 6707 | GTCN_39 | 597 | TTCN_1849 | 6750 |
| CTCN_60 | 555 | GTCN_1075 | 6708 | GTCN_40 | 598 | TTCN_1850 | 6751 |
| CTCN_61 | 556 | TTCN_1837 | 6709 | CTCN_78 | 599 | GTCN_1085 | 6752 |
| CTCN_62 | 557 | ATCN_1273 | 6710 | GTCN_41 | 600 | TTCN_1851 | 6753 |
| CTCN_63 | 558 | GTCN_1076 | 6711 | CTCN_79 | 601 | TTCN_1852 | 6754 |
| ATCN_32 | 559 | TTCN_1838 | 6712 | CTCN_80 | 602 | CTCN_1977 | 6755 |
| CTCN_64 | 560 | TTCN_1839 | 6713 | CTCN_81 | 603 | TTCN_1853 | 6756 |
| CTCN_65 | 561 | TTCN_1840 | 6714 | CTCN_82 | 604 | ATCN_1288 | 6757 |
| GTCN_33 | 562 | GTCN_1077 | 6715 | ATCN_44 | 605 | TTCN_1854 | 6758 |
| TTCN_59 | 563 | TTCN_1841 | 6716 | CTCN_83 | 606 | CTCN_1978 | 6759 |
| GTCN_34 | 564 | TTCN_1842 | 6717 | CTCN_84 | 607 | ATCN_1289 | 6760 |
| TTCN_60 | 565 | GTCN_1078 | 6718 | CTCN_85 | 608 | TTCN_1855 | 6761 |
| CTCN_66 | 566 | ATCN_1274 | 6719 | ATCN_45 | 609 | TTCN_1856 | 6762 |
| GTCN_35 | 567 | ATCN_1275 | 6720 | CTCN_86 | 610 | ATCN_1290 | 6763 |
| TTCN_61 | 568 | TTCN_1843 | 6721 | TTCN_65 | 611 | ATCN_1291 | 6764 |
| ATCN_33 | 569 | ATCN_1276 | 6722 | CTCN_87 | 612 | TTCN_1857 | 6765 |
| ATCN_34 | 570 | GTCN_1079 | 6723 | ATCN_46 | 613 | CTCN_1979 | 6766 |
| CTCN_67 | 571 | CTCN_1972 | 6724 | CTCN_88 | 614 | GTCN_1086 | 6767 |
| CTCN_68 | 572 | CTCN_1973 | 6725 | CTCN_89 | 615 | ATCN_1292 | 6768 |
| ATCN_35 | 573 | ATCN_1277 | 6726 | TTCN_66 | 616 | GTCN_1087 | 6769 |
| CTCN_69 | 574 | ATCN_1278 | 6727 | GTCN_42 | 617 | CTCN_1980 | 6770 |
| ATCN_36 | 575 | TTCN_1844 | 6728 | TTCN_67 | 618 | GTCN_1088 | 6771 |
| TTCN_62 | 576 | ATCN_1279 | 6729 | TTCN_68 | 619 | GTCN_1089 | 6772 |
| CTCN_70 | 577 | ATCN_1280 | 6730 | GTCN_43 | 620 | TTCN_1858 | 6773 |
| ATCN_37 | 578 | ATCN_1281 | 6731 | ATCN_47 | 621 | TTCN_1859 | 6774 |
| GTCN_36 | 579 | GTCN_1080 | 6732 | TTCN_69 | 622 | TTCN_1860 | 6775 |
| GTCN_37 | 580 | TTCN_1845 | 6733 | TTCN_70 | 623 | GTCN_1090 | 6776 |
| CTCN_71 | 581 | CTCN_1974 | 6734 | CTCN_90 | 624 | ATCN_1293 | 6777 |
| ATCN_38 | 582 | CTCN_1975 | 6735 | CTCN_91 | 625 | TTCN_1861 | 6778 |

FIG. 33 (continued)

| | | | | | | | |
|---|---|---|---|---|---|---|---|
| CTCN_92 | 626 | CTCN_1981 | 6779 | CTCN_109 | 669 | TTCN_1880 | 6822 |
| CTCN_93 | 627 | CTCN_1982 | 6780 | GTCN_53 | 670 | TTCN_1881 | 6823 |
| TTCN_71 | 628 | GTCN_1091 | 6781 | TTCN_81 | 671 | TTCN_1882 | 6824 |
| TTCN_72 | 629 | ATCN_1294 | 6782 | CTCN_110 | 672 | ATCN_1302 | 6825 |
| TTCN_73 | 630 | CTCN_1983 | 6783 | CTCN_111 | 673 | CTCN_1993 | 6826 |
| TTCN_74 | 631 | CTCN_1984 | 6784 | TTCN_82 | 674 | CTCN_1994 | 6827 |
| GTCN_44 | 632 | ATCN_1295 | 6785 | ATCN_55 | 675 | ATCN_1303 | 6828 |
| GTCN_45 | 633 | CTCN_1985 | 6786 | ATCN_56 | 676 | ATCN_1304 | 6829 |
| TTCN_75 | 634 | TTCN_1862 | 6787 | TTCN_83 | 677 | CTCN_1995 | 6830 |
| ATCN_48 | 635 | CTCN_1986 | 6788 | CTCN_112 | 678 | CTCN_1996 | 6831 |
| TTCN_76 | 636 | ATCN_1296 | 6789 | ATCN_57 | 679 | TTCN_1883 | 6832 |
| CTCN_94 | 637 | ATCN_1297 | 6790 | TTCN_84 | 680 | TTCN_1884 | 6833 |
| GTCN_46 | 638 | TTCN_1863 | 6791 | CTCN_113 | 681 | GTCN_1096 | 6834 |
| CTCN_95 | 639 | TTCN_1864 | 6792 | CTCN_114 | 682 | ATCN_1305 | 6835 |
| GTCN_47 | 640 | TTCN_1865 | 6793 | ATCN_58 | 683 | TTCN_1885 | 6836 |
| CTCN_96 | 641 | GTCN_1092 | 6794 | ATCN_59 | 684 | TTCN_1886 | 6837 |
| CTCN_97 | 642 | ATCN_1298 | 6795 | CTCN_115 | 685 | TTCN_1887 | 6838 |
| ATCN_49 | 643 | ATCN_1299 | 6796 | CTCN_116 | 686 | ATCN_1306 | 6839 |
| CTCN_98 | 644 | TTCN_1866 | 6797 | CTCN_117 | 687 | CTCN_1997 | 6840 |
| GTCN_48 | 645 | ATCN_1300 | 6798 | CTCN_118 | 688 | CTCN_1998 | 6841 |
| CTCN_99 | 646 | TTCN_1867 | 6799 | GTCN_54 | 689 | TTCN_1888 | 6842 |
| CTCN_100 | 647 | TTCN_1868 | 6800 | TTCN_85 | 690 | TTCN_1889 | 6843 |
| CTCN_101 | 648 | GTCN_1093 | 6801 | GTCN_55 | 691 | TTCN_1890 | 6844 |
| ATCN_50 | 649 | TTCN_1869 | 6802 | CTCN_119 | 692 | CTCN_1999 | 6845 |
| ATCN_51 | 650 | CTCN_1987 | 6803 | TTCN_86 | 693 | CTCN_2000 | 6846 |
| GTCN_49 | 651 | TTCN_1870 | 6804 | GTCN_56 | 694 | GTCN_1097 | 6847 |
| CTCN_102 | 652 | TTCN_1871 | 6805 | TTCN_87 | 695 | CTCN_2001 | 6848 |
| ATCN_52 | 653 | TTCN_1872 | 6806 | ATCN_60 | 696 | TTCN_1891 | 6849 |
| TTCN_77 | 654 | CTCN_1988 | 6807 | CTCN_120 | 697 | TTCN_1892 | 6850 |
| CTCN_103 | 655 | GTCN_1094 | 6808 | ATCN_61 | 698 | ATCN_1307 | 6851 |
| CTCN_104 | 656 | TTCN_1873 | 6809 | TTCN_88 | 699 | GTCN_1098 | 6852 |
| TTCN_78 | 657 | CTCN_1989 | 6810 | GTCN_57 | 700 | TTCN_1893 | 6853 |
| ATCN_53 | 658 | CTCN_1990 | 6811 | CTCN_121 | 701 | GTCN_1099 | 6854 |
| ATCN_54 | 659 | CTCN_1991 | 6812 | TTCN_89 | 702 | TTCN_1894 | 6855 |
| TTCN_79 | 660 | TTCN_1874 | 6813 | ATCN_62 | 703 | GTCN_1100 | 6856 |
| CTCN_105 | 661 | TTCN_1875 | 6814 | TTCN_90 | 704 | ATCN_1308 | 6857 |
| TTCN_80 | 662 | CTCN_1992 | 6815 | CTCN_122 | 705 | ATCN_1309 | 6858 |
| CTCN_106 | 663 | GTCN_1095 | 6816 | TTCN_91 | 706 | TTCN_1895 | 6859 |
| GTCN_50 | 664 | TTCN_1876 | 6817 | ATCN_63 | 707 | TTCN_1896 | 6860 |
| GTCN_51 | 665 | TTCN_1877 | 6818 | GTCN_58 | 708 | TTCN_1897 | 6861 |
| GTCN_52 | 666 | TTCN_1878 | 6819 | ATCN_64 | 709 | GTCN_1101 | 6862 |
| CTCN_107 | 667 | TTCN_1879 | 6820 | CTCN_123 | 710 | TTCN_1898 | 6863 |
| CTCN_108 | 668 | ATCN_1301 | 6821 | TTCN_92 | 711 | CTCN_2002 | 6864 |

FIG. 33 (continued)

| | | | | | | | |
|---|---|---|---|---|---|---|---|
| GTCN_59 | 712 | GTCN_1102 | 6865 | CTCN_133 | 755 | TTCN_1915 | 6908 |
| ATCN_65 | 713 | ATCN_1310 | 6866 | TTCN_104 | 756 | TTCN_1916 | 6909 |
| ATCN_66 | 714 | TTCN_1899 | 6867 | CTCN_134 | 757 | TTCN_1917 | 6910 |
| CTCN_124 | 715 | CTCN_2003 | 6868 | CTCN_135 | 758 | TTCN_1918 | 6911 |
| CTCN_125 | 716 | CTCN_2004 | 6869 | TTCN_105 | 759 | CTCN_2011 | 6912 |
| GTCN_60 | 717 | TTCN_1900 | 6870 | CTCN_136 | 760 | TTCN_1919 | 6913 |
| ATCN_67 | 718 | TTCN_1901 | 6871 | TTCN_106 | 761 | TTCN_1920 | 6914 |
| CTCN_126 | 719 | GTCN_1103 | 6872 | TTCN_107 | 762 | TTCN_1921 | 6915 |
| TTCN_93 | 720 | ATCN_1311 | 6873 | GTCN_69 | 763 | TTCN_1922 | 6916 |
| TTCN_94 | 721 | TTCN_1902 | 6874 | TTCN_108 | 764 | TTCN_1923 | 6917 |
| TTCN_95 | 722 | CTCN_2005 | 6875 | TTCN_109 | 765 | GTCN_1109 | 6918 |
| GTCN_61 | 723 | ATCN_1312 | 6876 | TTCN_110 | 766 | CTCN_2012 | 6919 |
| ATCN_68 | 724 | GTCN_1104 | 6877 | GTCN_70 | 767 | CTCN_2013 | 6920 |
| ATCN_69 | 725 | CTCN_2006 | 6878 | CTCN_137 | 768 | ATCN_1322 | 6921 |
| ATCN_70 | 726 | CTCN_2007 | 6879 | GTCN_71 | 769 | TTCN_1924 | 6922 |
| GTCN_62 | 727 | TTCN_1903 | 6880 | TTCN_111 | 770 | TTCN_1925 | 6923 |
| TTCN_96 | 728 | CTCN_2008 | 6881 | TTCN_112 | 771 | TTCN_1926 | 6924 |
| ATCN_71 | 729 | ATCN_1313 | 6882 | CTCN_138 | 772 | ATCN_1323 | 6925 |
| GTCN_63 | 730 | TTCN_1904 | 6883 | ATCN_78 | 773 | TTCN_1927 | 6926 |
| GTCN_64 | 731 | GTCN_1105 | 6884 | CTCN_139 | 774 | GTCN_1110 | 6927 |
| CTCN_127 | 732 | CTCN_2009 | 6885 | GTCN_72 | 775 | TTCN_1928 | 6928 |
| CTCN_128 | 733 | TTCN_1905 | 6886 | GTCN_73 | 776 | GTCN_1111 | 6929 |
| ATCN_72 | 734 | CTCN_2010 | 6887 | ATCN_79 | 777 | ATCN_1324 | 6930 |
| ATCN_73 | 735 | TTCN_1906 | 6888 | GTCN_74 | 778 | ATCN_1325 | 6931 |
| CTCN_129 | 736 | TTCN_1907 | 6889 | TTCN_113 | 779 | ATCN_1326 | 6932 |
| ATCN_74 | 737 | TTCN_1908 | 6890 | TTCN_114 | 780 | TTCN_1929 | 6933 |
| GTCN_65 | 738 | ATCN_1314 | 6891 | GTCN_75 | 781 | ATCN_1327 | 6934 |
| ATCN_75 | 739 | GTCN_1106 | 6892 | GTCN_76 | 782 | CTCN_2014 | 6935 |
| TTCN_97 | 740 | ATCN_1315 | 6893 | ATCN_80 | 783 | TTCN_1930 | 6936 |
| ATCN_76 | 741 | GTCN_1107 | 6894 | CTCN_140 | 784 | TTCN_1931 | 6937 |
| TTCN_98 | 742 | ATCN_1316 | 6895 | TTCN_115 | 785 | CTCN_2015 | 6938 |
| CTCN_130 | 743 | TTCN_1909 | 6896 | CTCN_141 | 786 | ATCN_1328 | 6939 |
| GTCN_66 | 744 | TTCN_1910 | 6897 | ATCN_81 | 787 | TTCN_1932 | 6940 |
| ATCN_77 | 745 | ATCN_1317 | 6898 | CTCN_142 | 788 | TTCN_1933 | 6941 |
| CTCN_131 | 746 | TTCN_1911 | 6899 | ATCN_82 | 789 | GTCN_1112 | 6942 |
| GTCN_67 | 747 | GTCN_1108 | 6900 | ATCN_83 | 790 | GTCN_1113 | 6943 |
| TTCN_99 | 748 | ATCN_1318 | 6901 | CTCN_143 | 791 | CTCN_2016 | 6944 |
| GTCN_68 | 749 | TTCN_1912 | 6902 | TTCN_116 | 792 | ATCN_1329 | 6945 |
| TTCN_100 | 750 | ATCN_1319 | 6903 | TTCN_117 | 793 | TTCN_1934 | 6946 |
| CTCN_132 | 751 | TTCN_1913 | 6904 | TTCN_118 | 794 | CTCN_2017 | 6947 |
| TTCN_101 | 752 | ATCN_1320 | 6905 | GTCN_77 | 795 | TTCN_1935 | 6948 |
| TTCN_102 | 753 | ATCN_1321 | 6906 | TTCN_119 | 796 | GTCN_1114 | 6949 |
| TTCN_103 | 754 | TTCN_1914 | 6907 | ATCN_84 | 797 | TTCN_1936 | 6950 |

FIG. 33 (continued)

| | | | | | | | |
|---|---|---|---|---|---|---|---|
| CTCN_144 | 798 | ATCN_1330 | 6951 | TTCN_139 | 841 | CTCN_2031 | 6994 |
| TTCN_120 | 799 | GTCN_1115 | 6952 | CTCN_155 | 842 | CTCN_2032 | 6995 |
| TTCN_121 | 800 | GTCN_1116 | 6953 | CTCN_156 | 843 | CTCN_2033 | 6996 |
| ATCN_85 | 801 | CTCN_2018 | 6954 | TTCN_140 | 844 | TTCN_1952 | 6997 |
| CTCN_145 | 802 | CTCN_2019 | 6955 | ATCN_92 | 845 | ATCN_1337 | 6998 |
| CTCN_146 | 803 | GTCN_1117 | 6956 | ATCN_93 | 846 | TTCN_1953 | 6999 |
| TTCN_122 | 804 | TTCN_1937 | 6957 | TTCN_141 | 847 | TTCN_1954 | 7000 |
| TTCN_123 | 805 | ATCN_1331 | 6958 | TTCN_142 | 848 | ATCN_1338 | 7001 |
| ATCN_86 | 806 | TTCN_1938 | 6959 | GTCN_84 | 849 | CTCN_2034 | 7002 |
| TTCN_124 | 807 | TTCN_1939 | 6960 | GTCN_85 | 850 | CTCN_2035 | 7003 |
| TTCN_125 | 808 | TTCN_1940 | 6961 | CTCN_157 | 851 | CTCN_2036 | 7004 |
| TTCN_126 | 809 | TTCN_1941 | 6962 | ATCN_94 | 852 | TTCN_1955 | 7005 |
| GTCN_78 | 810 | CTCN_2020 | 6963 | TTCN_143 | 853 | TTCN_1956 | 7006 |
| TTCN_127 | 811 | ATCN_1332 | 6964 | ATCN_95 | 854 | GTCN_1123 | 7007 |
| TTCN_128 | 812 | CTCN_2021 | 6965 | CTCN_158 | 855 | CTCN_2037 | 7008 |
| TTCN_129 | 813 | CTCN_2022 | 6966 | GTCN_86 | 856 | GTCN_1124 | 7009 |
| GTCN_79 | 814 | TTCN_1942 | 6967 | TTCN_144 | 857 | TTCN_1957 | 7010 |
| ATCN_87 | 815 | GTCN_1118 | 6968 | TTCN_145 | 858 | CTCN_2038 | 7011 |
| CTCN_147 | 816 | CTCN_2023 | 6969 | GTCN_87 | 859 | TTCN_1958 | 7012 |
| CTCN_148 | 817 | CTCN_2024 | 6970 | ATCN_96 | 860 | TTCN_1959 | 7013 |
| CTCN_149 | 818 | TTCN_1943 | 6971 | CTCN_159 | 861 | GTCN_1125 | 7014 |
| TTCN_130 | 819 | ATCN_1333 | 6972 | CTCN_160 | 862 | TTCN_1960 | 7015 |
| TTCN_131 | 820 | GTCN_1119 | 6973 | CTCN_161 | 863 | CTCN_2039 | 7016 |
| GTCN_80 | 821 | TTCN_1944 | 6974 | ATCN_97 | 864 | TTCN_1961 | 7017 |
| TTCN_132 | 822 | TTCN_1945 | 6975 | TTCN_146 | 865 | GTCN_1126 | 7018 |
| TTCN_133 | 823 | TTCN_1946 | 6976 | ATCN_98 | 866 | GTCN_1127 | 7019 |
| TTCN_134 | 824 | TTCN_1947 | 6977 | CTCN_162 | 867 | CTCN_2040 | 7020 |
| ATCN_88 | 825 | ATCN_1334 | 6978 | CTCN_163 | 868 | TTCN_1962 | 7021 |
| CTCN_150 | 826 | TTCN_1948 | 6979 | CTCN_164 | 869 | TTCN_1963 | 7022 |
| TTCN_135 | 827 | CTCN_2025 | 6980 | CTCN_165 | 870 | CTCN_2041 | 7023 |
| TTCN_136 | 828 | ATCN_1335 | 6981 | TTCN_147 | 871 | TTCN_1964 | 7024 |
| CTCN_151 | 829 | ATCN_1336 | 6982 | CTCN_166 | 872 | TTCN_1965 | 7025 |
| CTCN_152 | 830 | CTCN_2026 | 6983 | ATCN_99 | 873 | TTCN_1966 | 7026 |
| GTCN_81 | 831 | CTCN_2027 | 6984 | TTCN_148 | 874 | CTCN_2042 | 7027 |
| ATCN_89 | 832 | CTCN_2028 | 6985 | TTCN_149 | 875 | CTCN_2043 | 7028 |
| GTCN_82 | 833 | TTCN_1949 | 6986 | TTCN_150 | 876 | CTCN_2044 | 7029 |
| GTCN_83 | 834 | GTCN_1120 | 6987 | TTCN_151 | 877 | GTCN_1128 | 7030 |
| ATCN_90 | 835 | GTCN_1121 | 6988 | ATCN_100 | 878 | CTCN_2045 | 7031 |
| CTCN_153 | 836 | TTCN_1950 | 6989 | TTCN_152 | 879 | CTCN_2046 | 7032 |
| CTCN_154 | 837 | TTCN_1951 | 6990 | TTCN_153 | 880 | ATCN_1339 | 7033 |
| ATCN_91 | 838 | GTCN_1122 | 6991 | CTCN_167 | 881 | CTCN_2047 | 7034 |
| TTCN_137 | 839 | CTCN_2029 | 6992 | CTCN_168 | 882 | TTCN_1967 | 7035 |
| TTCN_138 | 840 | CTCN_2030 | 6993 | ATCN_101 | 883 | ATCN_1340 | 7036 |

FIG. 33 (continued)

| | | | | | | | |
|---|---|---|---|---|---|---|---|
| GTCN_88 | 884 | CTCN_2048 | 7037 | ATCN_109 | 927 | TTCN_1980 | 7080 |
| ATCN_102 | 885 | CTCN_2049 | 7038 | ATCN_110 | 928 | CTCN_2064 | 7081 |
| GTCN_89 | 886 | CTCN_2050 | 7039 | CTCN_186 | 929 | ATCN_1348 | 7082 |
| ATCN_103 | 887 | CTCN_2051 | 7040 | CTCN_187 | 930 | TTCN_1981 | 7083 |
| CTCN_169 | 888 | GTCN_1129 | 7041 | ATCN_111 | 931 | GTCN_1137 | 7084 |
| TTCN_154 | 889 | CTCN_2052 | 7042 | CTCN_188 | 932 | CTCN_2065 | 7085 |
| TTCN_155 | 890 | ATCN_1341 | 7043 | GTCN_93 | 933 | GTCN_1138 | 7086 |
| CTCN_170 | 891 | CTCN_2053 | 7044 | GTCN_94 | 934 | TTCN_1982 | 7087 |
| CTCN_171 | 892 | GTCN_1130 | 7045 | CTCN_189 | 935 | GTCN_1139 | 7088 |
| CTCN_172 | 893 | TTCN_1968 | 7046 | CTCN_190 | 936 | CTCN_2066 | 7089 |
| CTCN_173 | 894 | CTCN_2054 | 7047 | CTCN_191 | 937 | TTCN_1983 | 7090 |
| TTCN_156 | 895 | CTCN_2055 | 7048 | TTCN_168 | 938 | TTCN_1984 | 7091 |
| TTCN_157 | 896 | TTCN_1969 | 7049 | CTCN_192 | 939 | GTCN_1140 | 7092 |
| CTCN_174 | 897 | GTCN_1131 | 7050 | TTCN_169 | 940 | TTCN_1985 | 7093 |
| CTCN_175 | 898 | CTCN_2056 | 7051 | TTCN_170 | 941 | TTCN_1986 | 7094 |
| ATCN_104 | 899 | GTCN_1132 | 7052 | CTCN_193 | 942 | CTCN_2067 | 7095 |
| CTCN_176 | 900 | GTCN_1133 | 7053 | TTCN_171 | 943 | CTCN_2068 | 7096 |
| TTCN_158 | 901 | CTCN_2057 | 7054 | CTCN_194 | 944 | ATCN_1349 | 7097 |
| TTCN_159 | 902 | CTCN_2058 | 7055 | CTCN_195 | 945 | GTCN_1141 | 7098 |
| TTCN_160 | 903 | TTCN_1970 | 7056 | CTCN_196 | 946 | CTCN_2069 | 7099 |
| CTCN_177 | 904 | CTCN_2059 | 7057 | TTCN_172 | 947 | ATCN_1350 | 7100 |
| CTCN_178 | 905 | CTCN_2060 | 7058 | CTCN_197 | 948 | GTCN_1142 | 7101 |
| CTCN_179 | 906 | CTCN_2061 | 7059 | CTCN_198 | 949 | ATCN_1351 | 7102 |
| TTCN_161 | 907 | GTCN_1134 | 7060 | TTCN_173 | 950 | TTCN_1987 | 7103 |
| TTCN_162 | 908 | ATCN_1342 | 7061 | GTCN_95 | 951 | CTCN_2070 | 7104 |
| TTCN_163 | 909 | CTCN_2062 | 7062 | CTCN_199 | 952 | TTCN_1988 | 7105 |
| TTCN_164 | 910 | ATCN_1343 | 7063 | TTCN_174 | 953 | CTCN_2071 | 7106 |
| ATCN_105 | 911 | ATCN_1344 | 7064 | CTCN_200 | 954 | CTCN_2072 | 7107 |
| TTCN_165 | 912 | TTCN_1971 | 7065 | TTCN_175 | 955 | ATCN_1352 | 7108 |
| ATCN_106 | 913 | TTCN_1972 | 7066 | GTCN_96 | 956 | CTCN_2073 | 7109 |
| CTCN_180 | 914 | GTCN_1135 | 7067 | ATCN_112 | 957 | GTCN_1143 | 7110 |
| CTCN_181 | 915 | TTCN_1973 | 7068 | GTCN_97 | 958 | TTCN_1989 | 7111 |
| TTCN_166 | 916 | TTCN_1974 | 7069 | CTCN_201 | 959 | GTCN_1144 | 7112 |
| GTCN_90 | 917 | ATCN_1345 | 7070 | GTCN_98 | 960 | ATCN_1353 | 7113 |
| ATCN_107 | 918 | ATCN_1346 | 7071 | CTCN_202 | 961 | TTCN_1990 | 7114 |
| CTCN_182 | 919 | TTCN_1975 | 7072 | CTCN_203 | 962 | GTCN_1145 | 7115 |
| ATCN_108 | 920 | TTCN_1976 | 7073 | ATCN_113 | 963 | GTCN_1146 | 7116 |
| CTCN_183 | 921 | TTCN_1977 | 7074 | CTCN_204 | 964 | CTCN_2074 | 7117 |
| GTCN_91 | 922 | GTCN_1136 | 7075 | TTCN_176 | 965 | CTCN_2075 | 7118 |
| CTCN_184 | 923 | CTCN_2063 | 7076 | ATCN_114 | 966 | GTCN_1147 | 7119 |
| TTCN_167 | 924 | TTCN_1978 | 7077 | ATCN_115 | 967 | GTCN_1148 | 7120 |
| CTCN_185 | 925 | TTCN_1979 | 7078 | GTCN_99 | 968 | TTCN_1991 | 7121 |
| GTCN_92 | 926 | ATCN_1347 | 7079 | GTCN_100 | 969 | ATCN_1354 | 7122 |

FIG. 33 (continued)

| | | | | | | | | |
|---|---|---|---|---|---|---|---|---|
| CTCN_205 | 970 | CTCN_2076 | 7123 | ATCN_128 | 1013 | ATCN_1360 | 7166 |
| TTCN_177 | 971 | TTCN_1992 | 7124 | ATCN_129 | 1014 | ATCN_1361 | 7167 |
| TTCN_178 | 972 | TTCN_1993 | 7125 | ATCN_130 | 1015 | CTCN_2087 | 7168 |
| ATCN_116 | 973 | TTCN_1994 | 7126 | GTCN_105 | 1016 | GTCN_1157 | 7169 |
| ATCN_117 | 974 | ATCN_1355 | 7127 | CTCN_218 | 1017 | CTCN_2088 | 7170 |
| CTCN_206 | 975 | TTCN_1995 | 7128 | CTCN_219 | 1018 | GTCN_1158 | 7171 |
| ATCN_118 | 976 | TTCN_1996 | 7129 | CTCN_220 | 1019 | CTCN_2089 | 7172 |
| GTCN_101 | 977 | CTCN_2077 | 7130 | CTCN_221 | 1020 | ATCN_1362 | 7173 |
| TTCN_179 | 978 | GTCN_1149 | 7131 | ATCN_131 | 1021 | GTCN_1159 | 7174 |
| TTCN_180 | 979 | CTCN_2078 | 7132 | GTCN_106 | 1022 | ATCN_1363 | 7175 |
| CTCN_207 | 980 | GTCN_1150 | 7133 | GTCN_107 | 1023 | ATCN_1364 | 7176 |
| ATCN_119 | 981 | ATCN_1356 | 7134 | TTCN_191 | 1024 | TTCN_2011 | 7177 |
| CTCN_208 | 982 | CTCN_2079 | 7135 | GTCN_108 | 1025 | TTCN_2012 | 7178 |
| ATCN_120 | 983 | TTCN_1997 | 7136 | GTCN_109 | 1026 | TTCN_2013 | 7179 |
| ATCN_121 | 984 | TTCN_1998 | 7137 | GTCN_110 | 1027 | ATCN_1365 | 7180 |
| TTCN_181 | 985 | TTCN_1999 | 7138 | CTCN_222 | 1028 | CTCN_2090 | 7181 |
| TTCN_182 | 986 | CTCN_2080 | 7139 | ATCN_132 | 1029 | ATCN_1366 | 7182 |
| ATCN_122 | 987 | GTCN_1151 | 7140 | GTCN_111 | 1030 | GTCN_1160 | 7183 |
| ATCN_123 | 988 | ATCN_1357 | 7141 | TTCN_192 | 1031 | TTCN_2014 | 7184 |
| CTCN_209 | 989 | CTCN_2081 | 7142 | CTCN_223 | 1032 | CTCN_2091 | 7185 |
| CTCN_210 | 990 | TTCN_2000 | 7143 | CTCN_224 | 1033 | TTCN_2015 | 7186 |
| TTCN_183 | 991 | TTCN_2001 | 7144 | TTCN_193 | 1034 | TTCN_2016 | 7187 |
| CTCN_211 | 992 | GTCN_1152 | 7145 | CTCN_225 | 1035 | TTCN_2017 | 7188 |
| ATCN_124 | 993 | TTCN_2002 | 7146 | CTCN_226 | 1036 | TTCN_2018 | 7189 |
| TTCN_184 | 994 | CTCN_2082 | 7147 | CTCN_227 | 1037 | TTCN_2019 | 7190 |
| CTCN_212 | 995 | CTCN_2083 | 7148 | TTCN_194 | 1038 | TTCN_2020 | 7191 |
| CTCN_213 | 996 | TTCN_2003 | 7149 | ATCN_133 | 1039 | TTCN_2021 | 7192 |
| GTCN_102 | 997 | GTCN_1153 | 7150 | GTCN_112 | 1040 | TTCN_2022 | 7193 |
| CTCN_214 | 998 | CTCN_2084 | 7151 | TTCN_195 | 1041 | GTCN_1161 | 7194 |
| CTCN_215 | 999 | ATCN_1358 | 7152 | ATCN_134 | 1042 | TTCN_2023 | 7195 |
| GTCN_103 | 1000 | TTCN_2004 | 7153 | GTCN_113 | 1043 | GTCN_1162 | 7196 |
| TTCN_185 | 1001 | ATCN_1359 | 7154 | ATCN_135 | 1044 | TTCN_2024 | 7197 |
| TTCN_186 | 1002 | TTCN_2005 | 7155 | ATCN_136 | 1045 | TTCN_2025 | 7198 |
| CTCN_216 | 1003 | TTCN_2006 | 7156 | ATCN_137 | 1046 | ATCN_1367 | 7199 |
| ATCN_125 | 1004 | GTCN_1154 | 7157 | CTCN_228 | 1047 | CTCN_2092 | 7200 |
| TTCN_187 | 1005 | TTCN_2007 | 7158 | ATCN_138 | 1048 | CTCN_2093 | 7201 |
| CTCN_217 | 1006 | CTCN_2085 | 7159 | ATCN_139 | 1049 | ATCN_1368 | 7202 |
| TTCN_188 | 1007 | GTCN_1155 | 7160 | GTCN_114 | 1050 | CTCN_2094 | 7203 |
| ATCN_126 | 1008 | GTCN_1156 | 7161 | CTCN_229 | 1051 | GTCN_1163 | 7204 |
| TTCN_189 | 1009 | TTCN_2008 | 7162 | CTCN_230 | 1052 | TTCN_2026 | 7205 |
| ATCN_127 | 1010 | TTCN_2009 | 7163 | GTCN_115 | 1053 | GTCN_1164 | 7206 |
| GTCN_104 | 1011 | CTCN_2086 | 7164 | GTCN_116 | 1054 | TTCN_2027 | 7207 |
| TTCN_190 | 1012 | TTCN_2010 | 7165 | GTCN_117 | 1055 | TTCN_2028 | 7208 |

FIG. 33 (continued)

| | | | | | | | |
|---|---|---|---|---|---|---|---|
| CTCN_231 | 1056 | TTCN_2029 | 7209 | TTCN_210 | 1099 | CTCN_2102 | 7252 |
| CTCN_232 | 1057 | TTCN_2030 | 7210 | ATCN_145 | 1100 | ATCN_1380 | 7253 |
| CTCN_233 | 1058 | ATCN_1369 | 7211 | TTCN_211 | 1101 | TTCN_2046 | 7254 |
| CTCN_234 | 1059 | CTCN_2095 | 7212 | TTCN_212 | 1102 | CTCN_2103 | 7255 |
| GTCN_118 | 1060 | CTCN_2096 | 7213 | TTCN_213 | 1103 | TTCN_2047 | 7256 |
| TTCN_196 | 1061 | ATCN_1370 | 7214 | TTCN_214 | 1104 | ATCN_1381 | 7257 |
| GTCN_119 | 1062 | GTCN_1165 | 7215 | TTCN_215 | 1105 | TTCN_2048 | 7258 |
| GTCN_120 | 1063 | ATCN_1371 | 7216 | GTCN_124 | 1106 | CTCN_2104 | 7259 |
| TTCN_197 | 1064 | TTCN_2031 | 7217 | ATCN_146 | 1107 | TTCN_2049 | 7260 |
| CTCN_235 | 1065 | CTCN_2097 | 7218 | TTCN_216 | 1108 | GTCN_1173 | 7261 |
| CTCN_236 | 1066 | TTCN_2032 | 7219 | TTCN_217 | 1109 | TTCN_2050 | 7262 |
| CTCN_237 | 1067 | ATCN_1372 | 7220 | TTCN_218 | 1110 | TTCN_2051 | 7263 |
| ATCN_140 | 1068 | TTCN_2033 | 7221 | CTCN_249 | 1111 | TTCN_2052 | 7264 |
| ATCN_141 | 1069 | TTCN_2034 | 7222 | CTCN_250 | 1112 | GTCN_1174 | 7265 |
| CTCN_238 | 1070 | TTCN_2035 | 7223 | GTCN_125 | 1113 | ATCN_1382 | 7266 |
| TTCN_198 | 1071 | TTCN_2036 | 7224 | CTCN_251 | 1114 | GTCN_1175 | 7267 |
| ATCN_142 | 1072 | GTCN_1166 | 7225 | GTCN_126 | 1115 | CTCN_2105 | 7268 |
| CTCN_239 | 1073 | CTCN_2098 | 7226 | TTCN_219 | 1116 | CTCN_2106 | 7269 |
| TTCN_199 | 1074 | ATCN_1373 | 7227 | GTCN_127 | 1117 | ATCN_1383 | 7270 |
| CTCN_240 | 1075 | ATCN_1374 | 7228 | TTCN_220 | 1118 | ATCN_1384 | 7271 |
| TTCN_200 | 1076 | TTCN_2037 | 7229 | CTCN_252 | 1119 | TTCN_2053 | 7272 |
| TTCN_201 | 1077 | GTCN_1167 | 7230 | GTCN_128 | 1120 | TTCN_2054 | 7273 |
| ATCN_143 | 1078 | GTCN_1168 | 7231 | CTCN_253 | 1121 | TTCN_2055 | 7274 |
| TTCN_202 | 1079 | TTCN_2038 | 7232 | CTCN_254 | 1122 | TTCN_2056 | 7275 |
| TTCN_203 | 1080 | GTCN_1169 | 7233 | ATCN_147 | 1123 | ATCN_1385 | 7276 |
| TTCN_204 | 1081 | TTCN_2039 | 7234 | ATCN_148 | 1124 | ATCN_1386 | 7277 |
| GTCN_121 | 1082 | ATCN_1375 | 7235 | CTCN_255 | 1125 | TTCN_2057 | 7278 |
| GTCN_122 | 1083 | TTCN_2040 | 7236 | TTCN_221 | 1126 | GTCN_1176 | 7279 |
| CTCN_241 | 1084 | TTCN_2041 | 7237 | GTCN_129 | 1127 | GTCN_1177 | 7280 |
| CTCN_242 | 1085 | ATCN_1376 | 7238 | CTCN_256 | 1128 | CTCN_2107 | 7281 |
| CTCN_243 | 1086 | CTCN_2099 | 7239 | TTCN_222 | 1129 | GTCN_1178 | 7282 |
| CTCN_244 | 1087 | ATCN_1377 | 7240 | ATCN_149 | 1130 | TTCN_2058 | 7283 |
| TTCN_205 | 1088 | CTCN_2100 | 7241 | TTCN_223 | 1131 | TTCN_2059 | 7284 |
| ATCN_144 | 1089 | GTCN_1170 | 7242 | CTCN_257 | 1132 | ATCN_1387 | 7285 |
| TTCN_206 | 1090 | TTCN_2042 | 7243 | CTCN_258 | 1133 | TTCN_2060 | 7286 |
| CTCN_245 | 1091 | CTCN_2101 | 7244 | TTCN_224 | 1134 | TTCN_2061 | 7287 |
| CTCN_246 | 1092 | TTCN_2043 | 7245 | ATCN_150 | 1135 | TTCN_2062 | 7288 |
| CTCN_247 | 1093 | GTCN_1171 | 7246 | TTCN_225 | 1136 | TTCN_2063 | 7289 |
| TTCN_207 | 1094 | TTCN_2044 | 7247 | TTCN_226 | 1137 | ATCN_1388 | 7290 |
| CTCN_248 | 1095 | ATCN_1378 | 7248 | TTCN_227 | 1138 | CTCN_2108 | 7291 |
| GTCN_123 | 1096 | TTCN_2045 | 7249 | TTCN_228 | 1139 | TTCN_2064 | 7292 |
| TTCN_208 | 1097 | GTCN_1172 | 7250 | TTCN_229 | 1140 | CTCN_2109 | 7293 |
| TTCN_209 | 1098 | ATCN_1379 | 7251 | TTCN_230 | 1141 | ATCN_1389 | 7294 |

FIG. 33 (continued)

| | | | | | | | |
|---|---|---|---|---|---|---|---|
| ATCN_151 | 1142 | CTCN_2110 | 7295 | TTCN_242 | 1185 | CTCN_2119 | 7338 |
| CTCN_259 | 1143 | GTCN_1179 | 7296 | TTCN_243 | 1186 | CTCN_2120 | 7339 |
| GTCN_130 | 1144 | TTCN_2065 | 7297 | CTCN_269 | 1187 | ATCN_1403 | 7340 |
| CTCN_260 | 1145 | TTCN_2066 | 7298 | CTCN_270 | 1188 | TTCN_2080 | 7341 |
| GTCN_131 | 1146 | ATCN_1390 | 7299 | CTCN_271 | 1189 | ATCN_1404 | 7342 |
| TTCN_231 | 1147 | TTCN_2067 | 7300 | CTCN_272 | 1190 | TTCN_2081 | 7343 |
| GTCN_132 | 1148 | TTCN_2068 | 7301 | ATCN_166 | 1191 | ATCN_1405 | 7344 |
| TTCN_232 | 1149 | TTCN_2069 | 7302 | TTCN_244 | 1192 | TTCN_2082 | 7345 |
| ATCN_152 | 1150 | GTCN_1180 | 7303 | GTCN_137 | 1193 | GTCN_1185 | 7346 |
| GTCN_133 | 1151 | CTCN_2111 | 7304 | ATCN_167 | 1194 | ATCN_1406 | 7347 |
| CTCN_261 | 1152 | ATCN_1391 | 7305 | CTCN_273 | 1195 | TTCN_2083 | 7348 |
| CTCN_262 | 1153 | GTCN_1181 | 7306 | CTCN_274 | 1196 | TTCN_2084 | 7349 |
| ATCN_153 | 1154 | TTCN_2070 | 7307 | ATCN_168 | 1197 | TTCN_2085 | 7350 |
| ATCN_154 | 1155 | CTCN_2112 | 7308 | ATCN_169 | 1198 | TTCN_2086 | 7351 |
| ATCN_155 | 1156 | ATCN_1392 | 7309 | CTCN_275 | 1199 | GTCN_1186 | 7352 |
| CTCN_263 | 1157 | GTCN_1182 | 7310 | CTCN_276 | 1200 | TTCN_2087 | 7353 |
| CTCN_264 | 1158 | ATCN_1393 | 7311 | CTCN_277 | 1201 | GTCN_1187 | 7354 |
| ATCN_156 | 1159 | CTCN_2113 | 7312 | TTCN_245 | 1202 | TTCN_2088 | 7355 |
| TTCN_233 | 1160 | TTCN_2071 | 7313 | GTCN_138 | 1203 | ATCN_1407 | 7356 |
| ATCN_157 | 1161 | CTCN_2114 | 7314 | ATCN_170 | 1204 | CTCN_2121 | 7357 |
| TTCN_234 | 1162 | CTCN_2115 | 7315 | CTCN_278 | 1205 | TTCN_2089 | 7358 |
| ATCN_158 | 1163 | TTCN_2072 | 7316 | CTCN_279 | 1206 | TTCN_2090 | 7359 |
| TTCN_235 | 1164 | ATCN_1394 | 7317 | TTCN_246 | 1207 | TTCN_2091 | 7360 |
| ATCN_159 | 1165 | ATCN_1395 | 7318 | TTCN_247 | 1208 | TTCN_2092 | 7361 |
| TTCN_236 | 1166 | GTCN_1183 | 7319 | TTCN_248 | 1209 | TTCN_2093 | 7362 |
| ATCN_160 | 1167 | TTCN_2073 | 7320 | ATCN_171 | 1210 | GTCN_1188 | 7363 |
| TTCN_237 | 1168 | GTCN_1184 | 7321 | TTCN_249 | 1211 | ATCN_1408 | 7364 |
| ATCN_161 | 1169 | ATCN_1396 | 7322 | CTCN_280 | 1212 | ATCN_1409 | 7365 |
| TTCN_238 | 1170 | CTCN_2116 | 7323 | TTCN_250 | 1213 | ATCN_1410 | 7366 |
| TTCN_239 | 1171 | TTCN_2074 | 7324 | CTCN_281 | 1214 | CTCN_2122 | 7367 |
| ATCN_162 | 1172 | CTCN_2117 | 7325 | TTCN_251 | 1215 | TTCN_2094 | 7368 |
| ATCN_163 | 1173 | ATCN_1397 | 7326 | TTCN_252 | 1216 | TTCN_2095 | 7369 |
| TTCN_240 | 1174 | TTCN_2075 | 7327 | TTCN_253 | 1217 | TTCN_2096 | 7370 |
| GTCN_134 | 1175 | ATCN_1398 | 7328 | CTCN_282 | 1218 | ATCN_1411 | 7371 |
| TTCN_241 | 1176 | ATCN_1399 | 7329 | ATCN_172 | 1219 | TTCN_2097 | 7372 |
| ATCN_164 | 1177 | ATCN_1400 | 7330 | ATCN_173 | 1220 | TTCN_2098 | 7373 |
| GTCN_135 | 1178 | CTCN_2118 | 7331 | GTCN_139 | 1221 | CTCN_2123 | 7374 |
| GTCN_136 | 1179 | ATCN_1401 | 7332 | TTCN_254 | 1222 | GTCN_1189 | 7375 |
| ATCN_165 | 1180 | TTCN_2076 | 7333 | TTCN_255 | 1223 | TTCN_2099 | 7376 |
| CTCN_265 | 1181 | TTCN_2077 | 7334 | CTCN_283 | 1224 | TTCN_2100 | 7377 |
| CTCN_266 | 1182 | TTCN_2078 | 7335 | TTCN_256 | 1225 | GTCN_1190 | 7378 |
| CTCN_267 | 1183 | ATCN_1402 | 7336 | TTCN_257 | 1226 | TTCN_2101 | 7379 |
| CTCN_268 | 1184 | TTCN_2079 | 7337 | ATCN_174 | 1227 | GTCN_1191 | 7380 |

FIG. 33 (continued)

| | | | | | | | |
|---|---|---|---|---|---|---|---|
| ATCN_175 | 1228 | TTCN_2102 | 7381 | TTCN_275 | 1271 | GTCN_1200 | 7424 |
| TTCN_258 | 1229 | CTCN_2124 | 7382 | CTCN_295 | 1272 | CTCN_2135 | 7425 |
| ATCN_176 | 1230 | ATCN_1412 | 7383 | TTCN_276 | 1273 | TTCN_2117 | 7426 |
| ATCN_177 | 1231 | CTCN_2125 | 7384 | TTCN_277 | 1274 | ATCN_1421 | 7427 |
| ATCN_178 | 1232 | GTCN_1192 | 7385 | CTCN_296 | 1275 | ATCN_1422 | 7428 |
| TTCN_259 | 1233 | CTCN_2126 | 7386 | CTCN_297 | 1276 | TTCN_2118 | 7429 |
| TTCN_260 | 1234 | TTCN_2103 | 7387 | ATCN_187 | 1277 | ATCN_1423 | 7430 |
| ATCN_179 | 1235 | ATCN_1413 | 7388 | TTCN_278 | 1278 | ATCN_1424 | 7431 |
| TTCN_261 | 1236 | CTCN_2127 | 7389 | ATCN_188 | 1279 | ATCN_1425 | 7432 |
| TTCN_262 | 1237 | GTCN_1193 | 7390 | TTCN_279 | 1280 | ATCN_1426 | 7433 |
| TTCN_263 | 1238 | ATCN_1414 | 7391 | CTCN_298 | 1281 | TTCN_2119 | 7434 |
| TTCN_264 | 1239 | GTCN_1194 | 7392 | ATCN_189 | 1282 | ATCN_1427 | 7435 |
| CTCN_284 | 1240 | TTCN_2104 | 7393 | GTCN_143 | 1283 | CTCN_2136 | 7436 |
| TTCN_265 | 1241 | ATCN_1415 | 7394 | ATCN_190 | 1284 | TTCN_2120 | 7437 |
| CTCN_285 | 1242 | ATCN_1416 | 7395 | ATCN_191 | 1285 | CTCN_2137 | 7438 |
| CTCN_286 | 1243 | CTCN_2128 | 7396 | TTCN_280 | 1286 | CTCN_2138 | 7439 |
| CTCN_287 | 1244 | TTCN_2105 | 7397 | GTCN_144 | 1287 | CTCN_2139 | 7440 |
| GTCN_140 | 1245 | CTCN_2129 | 7398 | CTCN_299 | 1288 | TTCN_2121 | 7441 |
| ATCN_180 | 1246 | TTCN_2106 | 7399 | CTCN_300 | 1289 | CTCN_2140 | 7442 |
| ATCN_181 | 1247 | GTCN_1195 | 7400 | CTCN_301 | 1290 | TTCN_2122 | 7443 |
| TTCN_266 | 1248 | ATCN_1417 | 7401 | CTCN_302 | 1291 | ATCN_1428 | 7444 |
| TTCN_267 | 1249 | GTCN_1196 | 7402 | CTCN_303 | 1292 | GTCN_1201 | 7445 |
| CTCN_288 | 1250 | TTCN_2107 | 7403 | ATCN_192 | 1293 | ATCN_1429 | 7446 |
| CTCN_289 | 1251 | TTCN_2108 | 7404 | CTCN_304 | 1294 | GTCN_1202 | 7447 |
| GTCN_141 | 1252 | CTCN_2130 | 7405 | GTCN_145 | 1295 | CTCN_2141 | 7448 |
| CTCN_290 | 1253 | TTCN_2109 | 7406 | CTCN_305 | 1296 | GTCN_1203 | 7449 |
| CTCN_291 | 1254 | GTCN_1197 | 7407 | ATCN_193 | 1297 | TTCN_2123 | 7450 |
| TTCN_268 | 1255 | ATCN_1418 | 7408 | ATCN_194 | 1298 | CTCN_2142 | 7451 |
| ATCN_182 | 1256 | TTCN_2110 | 7409 | CTCN_306 | 1299 | CTCN_2143 | 7452 |
| GTCN_142 | 1257 | TTCN_2111 | 7410 | ATCN_195 | 1300 | CTCN_2144 | 7453 |
| TTCN_269 | 1258 | TTCN_2112 | 7411 | TTCN_281 | 1301 | ATCN_1430 | 7454 |
| TTCN_270 | 1259 | CTCN_2131 | 7412 | GTCN_146 | 1302 | CTCN_2145 | 7455 |
| ATCN_183 | 1260 | TTCN_2113 | 7413 | CTCN_307 | 1303 | GTCN_1204 | 7456 |
| CTCN_292 | 1261 | ATCN_1419 | 7414 | GTCN_147 | 1304 | TTCN_2124 | 7457 |
| TTCN_271 | 1262 | CTCN_2132 | 7415 | TTCN_282 | 1305 | GTCN_1205 | 7458 |
| CTCN_293 | 1263 | TTCN_2114 | 7416 | CTCN_308 | 1306 | GTCN_1206 | 7459 |
| TTCN_272 | 1264 | CTCN_2133 | 7417 | ATCN_196 | 1307 | TTCN_2125 | 7460 |
| TTCN_273 | 1265 | ATCN_1420 | 7418 | CTCN_309 | 1308 | GTCN_1207 | 7461 |
| ATCN_184 | 1266 | GTCN_1198 | 7419 | TTCN_283 | 1309 | ATCN_1431 | 7462 |
| ATCN_185 | 1267 | TTCN_2115 | 7420 | ATCN_197 | 1310 | TTCN_2126 | 7463 |
| CTCN_294 | 1268 | CTCN_2134 | 7421 | ATCN_198 | 1311 | CTCN_2146 | 7464 |
| TTCN_274 | 1269 | TTCN_2116 | 7422 | TTCN_284 | 1312 | CTCN_2147 | 7465 |
| ATCN_186 | 1270 | GTCN_1199 | 7423 | CTCN_310 | 1313 | CTCN_2148 | 7466 |

FIG. 33 (continued)

| | | | | | | | |
|---|---|---|---|---|---|---|---|
| CTCN_311 | 1314 | ATCN_1432 | 7467 | GTCN_152 | 1357 | GTCN_1213 | 7510 |
| TTCN_285 | 1315 | GTCN_1208 | 7468 | ATCN_207 | 1358 | GTCN_1214 | 7511 |
| TTCN_286 | 1316 | ATCN_1433 | 7469 | ATCN_208 | 1359 | TTCN_2143 | 7512 |
| ATCN_199 | 1317 | ATCN_1434 | 7470 | GTCN_153 | 1360 | ATCN_1444 | 7513 |
| ATCN_200 | 1318 | TTCN_2127 | 7471 | TTCN_300 | 1361 | CTCN_2159 | 7514 |
| TTCN_287 | 1319 | CTCN_2149 | 7472 | TTCN_301 | 1362 | CTCN_2160 | 7515 |
| ATCN_201 | 1320 | ATCN_1435 | 7473 | CTCN_327 | 1363 | TTCN_2144 | 7516 |
| CTCN_312 | 1321 | CTCN_2150 | 7474 | GTCN_154 | 1364 | ATCN_1445 | 7517 |
| CTCN_313 | 1322 | TTCN_2128 | 7475 | TTCN_302 | 1365 | TTCN_2145 | 7518 |
| CTCN_314 | 1323 | TTCN_2129 | 7476 | GTCN_155 | 1366 | TTCN_2146 | 7519 |
| TTCN_288 | 1324 | CTCN_2151 | 7477 | CTCN_328 | 1367 | GTCN_1215 | 7520 |
| TTCN_289 | 1325 | GTCN_1209 | 7478 | GTCN_156 | 1368 | GTCN_1216 | 7521 |
| CTCN_315 | 1326 | TTCN_2130 | 7479 | ATCN_209 | 1369 | CTCN_2161 | 7522 |
| TTCN_290 | 1327 | CTCN_2152 | 7480 | TTCN_303 | 1370 | GTCN_1217 | 7523 |
| CTCN_316 | 1328 | GTCN_1210 | 7481 | ATCN_210 | 1371 | CTCN_2162 | 7524 |
| GTCN_148 | 1329 | ATCN_1436 | 7482 | CTCN_329 | 1372 | GTCN_1218 | 7525 |
| ATCN_202 | 1330 | CTCN_2153 | 7483 | TTCN_304 | 1373 | ATCN_1446 | 7526 |
| CTCN_317 | 1331 | TTCN_2131 | 7484 | CTCN_330 | 1374 | GTCN_1219 | 7527 |
| CTCN_318 | 1332 | TTCN_2132 | 7485 | GTCN_157 | 1375 | ATCN_1447 | 7528 |
| ATCN_203 | 1333 | TTCN_2133 | 7486 | TTCN_305 | 1376 | CTCN_2163 | 7529 |
| TTCN_291 | 1334 | TTCN_2134 | 7487 | TTCN_306 | 1377 | GTCN_1220 | 7530 |
| CTCN_319 | 1335 | CTCN_2154 | 7488 | TTCN_307 | 1378 | ATCN_1448 | 7531 |
| GTCN_149 | 1336 | TTCN_2135 | 7489 | GTCN_158 | 1379 | CTCN_2164 | 7532 |
| ATCN_204 | 1337 | ATCN_1437 | 7490 | ATCN_211 | 1380 | ATCN_1449 | 7533 |
| CTCN_320 | 1338 | TTCN_2136 | 7491 | ATCN_212 | 1381 | CTCN_2165 | 7534 |
| TTCN_292 | 1339 | GTCN_1211 | 7492 | CTCN_331 | 1382 | ATCN_1450 | 7535 |
| TTCN_293 | 1340 | ATCN_1438 | 7493 | CTCN_332 | 1383 | TTCN_2147 | 7536 |
| TTCN_294 | 1341 | ATCN_1439 | 7494 | TTCN_308 | 1384 | CTCN_2166 | 7537 |
| GTCN_150 | 1342 | ATCN_1440 | 7495 | ATCN_213 | 1385 | ATCN_1451 | 7538 |
| TTCN_295 | 1343 | CTCN_2155 | 7496 | ATCN_214 | 1386 | ATCN_1452 | 7539 |
| CTCN_321 | 1344 | GTCN_1212 | 7497 | ATCN_215 | 1387 | TTCN_2148 | 7540 |
| CTCN_322 | 1345 | ATCN_1441 | 7498 | GTCN_159 | 1388 | CTCN_2167 | 7541 |
| CTCN_323 | 1346 | ATCN_1442 | 7499 | GTCN_160 | 1389 | TTCN_2149 | 7542 |
| GTCN_151 | 1347 | TTCN_2137 | 7500 | CTCN_333 | 1390 | GTCN_1221 | 7543 |
| TTCN_296 | 1348 | TTCN_2138 | 7501 | GTCN_161 | 1391 | CTCN_2168 | 7544 |
| ATCN_205 | 1349 | TTCN_2139 | 7502 | ATCN_216 | 1392 | TTCN_2150 | 7545 |
| TTCN_297 | 1350 | CTCN_2156 | 7503 | GTCN_162 | 1393 | CTCN_2169 | 7546 |
| CTCN_324 | 1351 | CTCN_2157 | 7504 | TTCN_309 | 1394 | GTCN_1222 | 7547 |
| TTCN_298 | 1352 | TTCN_2140 | 7505 | TTCN_310 | 1395 | ATCN_1453 | 7548 |
| ATCN_206 | 1353 | TTCN_2141 | 7506 | CTCN_334 | 1396 | TTCN_2151 | 7549 |
| CTCN_325 | 1354 | ATCN_1443 | 7507 | ATCN_217 | 1397 | TTCN_2152 | 7550 |
| CTCN_326 | 1355 | TTCN_2142 | 7508 | ATCN_218 | 1398 | CTCN_2170 | 7551 |
| TTCN_299 | 1356 | CTCN_2158 | 7509 | ATCN_219 | 1399 | ATCN_1454 | 7552 |

FIG. 33 (continued)

| | | | | | | | |
|---|---|---|---|---|---|---|---|
| CTCN_335 | 1400 | CTCN_2171 | 7553 | GTCN_169 | 1443 | GTCN_1225 | 7596 |
| TTCN_311 | 1401 | CTCN_2172 | 7554 | TTCN_325 | 1444 | CTCN_2189 | 7597 |
| GTCN_163 | 1402 | CTCN_2173 | 7555 | ATCN_230 | 1445 | GTCN_1226 | 7598 |
| CTCN_336 | 1403 | ATCN_1455 | 7556 | ATCN_231 | 1446 | CTCN_2190 | 7599 |
| TTCN_312 | 1404 | ATCN_1456 | 7557 | ATCN_232 | 1447 | CTCN_2191 | 7600 |
| GTCN_164 | 1405 | ATCN_1457 | 7558 | TTCN_326 | 1448 | TTCN_2164 | 7601 |
| GTCN_165 | 1406 | GTCN_1223 | 7559 | ATCN_233 | 1449 | TTCN_2165 | 7602 |
| ATCN_220 | 1407 | TTCN_2153 | 7560 | ATCN_234 | 1450 | GTCN_1227 | 7603 |
| ATCN_221 | 1408 | TTCN_2154 | 7561 | CTCN_348 | 1451 | TTCN_2166 | 7604 |
| CTCN_337 | 1409 | TTCN_2155 | 7562 | GTCN_170 | 1452 | TTCN_2167 | 7605 |
| ATCN_222 | 1410 | CTCN_2174 | 7563 | CTCN_349 | 1453 | ATCN_1467 | 7606 |
| ATCN_223 | 1411 | TTCN_2156 | 7564 | GTCN_171 | 1454 | TTCN_2168 | 7607 |
| CTCN_338 | 1412 | CTCN_2175 | 7565 | TTCN_327 | 1455 | GTCN_1228 | 7608 |
| TTCN_313 | 1413 | CTCN_2176 | 7566 | GTCN_172 | 1456 | ATCN_1468 | 7609 |
| CTCN_339 | 1414 | TTCN_2157 | 7567 | GTCN_173 | 1457 | TTCN_2169 | 7610 |
| CTCN_340 | 1415 | TTCN_2158 | 7568 | TTCN_328 | 1458 | CTCN_2192 | 7611 |
| CTCN_341 | 1416 | CTCN_2177 | 7569 | CTCN_350 | 1459 | GTCN_1229 | 7612 |
| CTCN_342 | 1417 | CTCN_2178 | 7570 | GTCN_174 | 1460 | ATCN_1469 | 7613 |
| TTCN_314 | 1418 | ATCN_1458 | 7571 | TTCN_329 | 1461 | CTCN_2193 | 7614 |
| CTCN_343 | 1419 | ATCN_1459 | 7572 | GTCN_175 | 1462 | GTCN_1230 | 7615 |
| TTCN_315 | 1420 | CTCN_2179 | 7573 | ATCN_235 | 1463 | TTCN_2170 | 7616 |
| TTCN_316 | 1421 | TTCN_2159 | 7574 | ATCN_236 | 1464 | GTCN_1231 | 7617 |
| TTCN_317 | 1422 | ATCN_1460 | 7575 | CTCN_351 | 1465 | CTCN_2194 | 7618 |
| TTCN_318 | 1423 | TTCN_2160 | 7576 | ATCN_237 | 1466 | TTCN_2171 | 7619 |
| TTCN_319 | 1424 | ATCN_1461 | 7577 | TTCN_330 | 1467 | ATCN_1470 | 7620 |
| TTCN_320 | 1425 | CTCN_2180 | 7578 | GTCN_176 | 1468 | GTCN_1232 | 7621 |
| CTCN_344 | 1426 | CTCN_2181 | 7579 | ATCN_238 | 1469 | CTCN_2195 | 7622 |
| GTCN_166 | 1427 | TTCN_2161 | 7580 | CTCN_352 | 1470 | TTCN_2172 | 7623 |
| ATCN_224 | 1428 | ATCN_1462 | 7581 | ATCN_239 | 1471 | TTCN_2173 | 7624 |
| ATCN_225 | 1429 | ATCN_1463 | 7582 | CTCN_353 | 1472 | ATCN_1471 | 7625 |
| CTCN_345 | 1430 | CTCN_2182 | 7583 | TTCN_331 | 1473 | TTCN_2174 | 7626 |
| ATCN_226 | 1431 | CTCN_2183 | 7584 | ATCN_240 | 1474 | TTCN_2175 | 7627 |
| CTCN_346 | 1432 | GTCN_1224 | 7585 | TTCN_332 | 1475 | TTCN_2176 | 7628 |
| ATCN_227 | 1433 | CTCN_2184 | 7586 | ATCN_241 | 1476 | ATCN_1472 | 7629 |
| ATCN_228 | 1434 | CTCN_2185 | 7587 | GTCN_177 | 1477 | ATCN_1473 | 7630 |
| CTCN_347 | 1435 | CTCN_2186 | 7588 | TTCN_333 | 1478 | TTCN_2177 | 7631 |
| TTCN_321 | 1436 | ATCN_1464 | 7589 | ATCN_242 | 1479 | TTCN_2178 | 7632 |
| TTCN_322 | 1437 | TTCN_2162 | 7590 | CTCN_354 | 1480 | ATCN_1474 | 7633 |
| GTCN_167 | 1438 | ATCN_1465 | 7591 | CTCN_355 | 1481 | ATCN_1475 | 7634 |
| ATCN_229 | 1439 | CTCN_2187 | 7592 | TTCN_334 | 1482 | ATCN_1476 | 7635 |
| GTCN_168 | 1440 | TTCN_2163 | 7593 | CTCN_356 | 1483 | CTCN_2196 | 7636 |
| TTCN_323 | 1441 | ATCN_1466 | 7594 | ATCN_243 | 1484 | TTCN_2179 | 7637 |
| TTCN_324 | 1442 | CTCN_2188 | 7595 | TTCN_335 | 1485 | TTCN_2180 | 7638 |

FIG. 33 (continued)

| | | | | | | | |
|---|---|---|---|---|---|---|---|
| TTCN_336 | 1486 | CTCN_2197 | 7639 | ATCN_250 | 1529 | TTCN_2193 | 7682 |
| GTCN_178 | 1487 | ATCN_1477 | 7640 | TTCN_353 | 1530 | CTCN_2205 | 7683 |
| TTCN_337 | 1488 | GTCN_1233 | 7641 | TTCN_354 | 1531 | CTCN_2206 | 7684 |
| TTCN_338 | 1489 | TTCN_2181 | 7642 | ATCN_251 | 1532 | TTCN_2194 | 7685 |
| CTCN_357 | 1490 | GTCN_1234 | 7643 | GTCN_186 | 1533 | ATCN_1488 | 7686 |
| TTCN_339 | 1491 | CTCN_2198 | 7644 | GTCN_187 | 1534 | ATCN_1489 | 7687 |
| TTCN_340 | 1492 | TTCN_2182 | 7645 | ATCN_252 | 1535 | TTCN_2195 | 7688 |
| TTCN_341 | 1493 | TTCN_2183 | 7646 | TTCN_355 | 1536 | TTCN_2196 | 7689 |
| TTCN_342 | 1494 | ATCN_1478 | 7647 | ATCN_253 | 1537 | TTCN_2197 | 7690 |
| TTCN_343 | 1495 | GTCN_1235 | 7648 | CTCN_369 | 1538 | CTCN_2207 | 7691 |
| CTCN_358 | 1496 | GTCN_1236 | 7649 | CTCN_370 | 1539 | CTCN_2208 | 7692 |
| TTCN_344 | 1497 | GTCN_1237 | 7650 | CTCN_371 | 1540 | ATCN_1490 | 7693 |
| TTCN_345 | 1498 | ATCN_1479 | 7651 | CTCN_372 | 1541 | CTCN_2209 | 7694 |
| CTCN_359 | 1499 | TTCN_2184 | 7652 | TTCN_356 | 1542 | TTCN_2198 | 7695 |
| GTCN_179 | 1500 | CTCN_2199 | 7653 | TTCN_357 | 1543 | ATCN_1491 | 7696 |
| CTCN_360 | 1501 | TTCN_2185 | 7654 | TTCN_358 | 1544 | ATCN_1492 | 7697 |
| GTCN_180 | 1502 | ATCN_1480 | 7655 | CTCN_373 | 1545 | TTCN_2199 | 7698 |
| GTCN_181 | 1503 | GTCN_1238 | 7656 | GTCN_188 | 1546 | CTCN_2210 | 7699 |
| TTCN_346 | 1504 | TTCN_2186 | 7657 | CTCN_374 | 1547 | CTCN_2211 | 7700 |
| CTCN_361 | 1505 | TTCN_2187 | 7658 | ATCN_254 | 1548 | ATCN_1493 | 7701 |
| ATCN_244 | 1506 | ATCN_1481 | 7659 | ATCN_255 | 1549 | CTCN_2212 | 7702 |
| ATCN_245 | 1507 | TTCN_2188 | 7660 | CTCN_375 | 1550 | CTCN_2213 | 7703 |
| CTCN_362 | 1508 | ATCN_1482 | 7661 | GTCN_189 | 1551 | ATCN_1494 | 7704 |
| CTCN_363 | 1509 | GTCN_1239 | 7662 | TTCN_359 | 1552 | TTCN_2200 | 7705 |
| CTCN_364 | 1510 | TTCN_2189 | 7663 | TTCN_360 | 1553 | ATCN_1495 | 7706 |
| CTCN_365 | 1511 | GTCN_1240 | 7664 | ATCN_256 | 1554 | ATCN_1496 | 7707 |
| TTCN_347 | 1512 | TTCN_2190 | 7665 | GTCN_190 | 1555 | TTCN_2201 | 7708 |
| GTCN_182 | 1513 | ATCN_1483 | 7666 | GTCN_191 | 1556 | ATCN_1497 | 7709 |
| TTCN_348 | 1514 | ATCN_1484 | 7667 | CTCN_376 | 1557 | CTCN_2214 | 7710 |
| ATCN_246 | 1515 | TTCN_2191 | 7668 | GTCN_192 | 1558 | GTCN_1245 | 7711 |
| TTCN_349 | 1516 | ATCN_1485 | 7669 | TTCN_361 | 1559 | CTCN_2215 | 7712 |
| TTCN_350 | 1517 | CTCN_2200 | 7670 | TTCN_362 | 1560 | CTCN_2216 | 7713 |
| GTCN_183 | 1518 | GTCN_1241 | 7671 | CTCN_377 | 1561 | TTCN_2202 | 7714 |
| ATCN_247 | 1519 | GTCN_1242 | 7672 | TTCN_363 | 1562 | CTCN_2217 | 7715 |
| CTCN_366 | 1520 | GTCN_1243 | 7673 | ATCN_257 | 1563 | ATCN_1498 | 7716 |
| GTCN_184 | 1521 | CTCN_2201 | 7674 | CTCN_378 | 1564 | ATCN_1499 | 7717 |
| TTCN_351 | 1522 | ATCN_1486 | 7675 | GTCN_193 | 1565 | TTCN_2203 | 7718 |
| ATCN_248 | 1523 | ATCN_1487 | 7676 | CTCN_379 | 1566 | TTCN_2204 | 7719 |
| GTCN_185 | 1524 | GTCN_1244 | 7677 | TTCN_364 | 1567 | CTCN_2218 | 7720 |
| TTCN_352 | 1525 | CTCN_2202 | 7678 | GTCN_194 | 1568 | GTCN_1246 | 7721 |
| CTCN_367 | 1526 | CTCN_2203 | 7679 | TTCN_365 | 1569 | CTCN_2219 | 7722 |
| CTCN_368 | 1527 | CTCN_2204 | 7680 | TTCN_366 | 1570 | TTCN_2205 | 7723 |
| ATCN_249 | 1528 | TTCN_2192 | 7681 | TTCN_367 | 1571 | ATCN_1500 | 7724 |

FIG. 33 (continued)

| | | | | | | | |
|---|---|---|---|---|---|---|---|
| TTCN_368 | 1572 | GTCN_1247 | 7725 | TTCN_379 | 1615 | TTCN_2217 | 7768 |
| ATCN_258 | 1573 | CTCN_2220 | 7726 | ATCN_264 | 1616 | ATCN_1513 | 7769 |
| ATCN_259 | 1574 | TTCN_2206 | 7727 | ATCN_265 | 1617 | CTCN_2235 | 7770 |
| GTCN_195 | 1575 | ATCN_1501 | 7728 | CTCN_396 | 1618 | ATCN_1514 | 7771 |
| CTCN_380 | 1576 | ATCN_1502 | 7729 | TTCN_380 | 1619 | CTCN_2236 | 7772 |
| GTCN_196 | 1577 | ATCN_1503 | 7730 | CTCN_397 | 1620 | TTCN_2218 | 7773 |
| CTCN_381 | 1578 | GTCN_1248 | 7731 | CTCN_398 | 1621 | TTCN_2219 | 7774 |
| CTCN_382 | 1579 | ATCN_1504 | 7732 | CTCN_399 | 1622 | GTCN_1252 | 7775 |
| ATCN_260 | 1580 | ATCN_1505 | 7733 | TTCN_381 | 1623 | GTCN_1253 | 7776 |
| TTCN_369 | 1581 | TTCN_2207 | 7734 | TTCN_382 | 1624 | CTCN_2237 | 7777 |
| CTCN_383 | 1582 | CTCN_2221 | 7735 | TTCN_383 | 1625 | ATCN_1515 | 7778 |
| CTCN_384 | 1583 | CTCN_2222 | 7736 | GTCN_205 | 1626 | TTCN_2220 | 7779 |
| CTCN_385 | 1584 | CTCN_2223 | 7737 | CTCN_400 | 1627 | TTCN_2221 | 7780 |
| TTCN_370 | 1585 | CTCN_2224 | 7738 | CTCN_401 | 1628 | TTCN_2222 | 7781 |
| TTCN_371 | 1586 | TTCN_2208 | 7739 | CTCN_402 | 1629 | GTCN_1254 | 7782 |
| CTCN_386 | 1587 | TTCN_2209 | 7740 | CTCN_403 | 1630 | CTCN_2238 | 7783 |
| GTCN_197 | 1588 | CTCN_2225 | 7741 | ATCN_266 | 1631 | GTCN_1255 | 7784 |
| CTCN_387 | 1589 | TTCN_2210 | 7742 | CTCN_404 | 1632 | CTCN_2239 | 7785 |
| GTCN_198 | 1590 | ATCN_1506 | 7743 | CTCN_405 | 1633 | CTCN_2240 | 7786 |
| CTCN_388 | 1591 | ATCN_1507 | 7744 | CTCN_406 | 1634 | TTCN_2223 | 7787 |
| GTCN_199 | 1592 | CTCN_2226 | 7745 | ATCN_267 | 1635 | CTCN_2241 | 7788 |
| GTCN_200 | 1593 | CTCN_2227 | 7746 | ATCN_268 | 1636 | TTCN_2224 | 7789 |
| ATCN_261 | 1594 | ATCN_1508 | 7747 | CTCN_407 | 1637 | CTCN_2242 | 7790 |
| CTCN_389 | 1595 | TTCN_2211 | 7748 | CTCN_408 | 1638 | ATCN_1516 | 7791 |
| TTCN_372 | 1596 | CTCN_2228 | 7749 | TTCN_384 | 1639 | CTCN_2243 | 7792 |
| TTCN_373 | 1597 | ATCN_1509 | 7750 | CTCN_409 | 1640 | CTCN_2244 | 7793 |
| TTCN_374 | 1598 | CTCN_2229 | 7751 | GTCN_206 | 1641 | ATCN_1517 | 7794 |
| CTCN_390 | 1599 | CTCN_2230 | 7752 | TTCN_385 | 1642 | ATCN_1518 | 7795 |
| CTCN_391 | 1600 | ATCN_1510 | 7753 | GTCN_207 | 1643 | TTCN_2225 | 7796 |
| CTCN_392 | 1601 | GTCN_1249 | 7754 | CTCN_410 | 1644 | ATCN_1519 | 7797 |
| GTCN_201 | 1602 | CTCN_2231 | 7755 | GTCN_208 | 1645 | TTCN_2226 | 7798 |
| GTCN_202 | 1603 | CTCN_2232 | 7756 | CTCN_411 | 1646 | CTCN_2245 | 7799 |
| CTCN_393 | 1604 | TTCN_2212 | 7757 | CTCN_412 | 1647 | ATCN_1520 | 7800 |
| TTCN_375 | 1605 | TTCN_2213 | 7758 | TTCN_386 | 1648 | GTCN_1256 | 7801 |
| GTCN_203 | 1606 | GTCN_1250 | 7759 | CTCN_413 | 1649 | ATCN_1521 | 7802 |
| GTCN_204 | 1607 | TTCN_2214 | 7760 | GTCN_209 | 1650 | ATCN_1522 | 7803 |
| TTCN_376 | 1608 | TTCN_2215 | 7761 | ATCN_269 | 1651 | TTCN_2227 | 7804 |
| CTCN_394 | 1609 | ATCN_1511 | 7762 | ATCN_270 | 1652 | ATCN_1523 | 7805 |
| TTCN_377 | 1610 | CTCN_2233 | 7763 | TTCN_387 | 1653 | ATCN_1524 | 7806 |
| ATCN_262 | 1611 | TTCN_2216 | 7764 | ATCN_271 | 1654 | CTCN_2246 | 7807 |
| ATCN_263 | 1612 | GTCN_1251 | 7765 | GTCN_210 | 1655 | CTCN_2247 | 7808 |
| CTCN_395 | 1613 | CTCN_2234 | 7766 | TTCN_388 | 1656 | CTCN_2248 | 7809 |
| TTCN_378 | 1614 | ATCN_1512 | 7767 | TTCN_389 | 1657 | ATCN_1525 | 7810 |

FIG. 33 (continued)

| | | | | | | | |
|---|---|---|---|---|---|---|---|
| TTCN_390 | 1658 | ATCN_1526 | 7811 | TTCN_399 | 1701 | TTCN_2240 | 7854 |
| ATCN_272 | 1659 | TTCN_2228 | 7812 | TTCN_400 | 1702 | CTCN_2262 | 7855 |
| ATCN_273 | 1660 | ATCN_1527 | 7813 | GTCN_221 | 1703 | CTCN_2263 | 7856 |
| ATCN_274 | 1661 | CTCN_2249 | 7814 | CTCN_427 | 1704 | TTCN_2241 | 7857 |
| CTCN_414 | 1662 | CTCN_2250 | 7815 | GTCN_222 | 1705 | CTCN_2264 | 7858 |
| ATCN_275 | 1663 | GTCN_1257 | 7816 | CTCN_428 | 1706 | CTCN_2265 | 7859 |
| TTCN_391 | 1664 | TTCN_2229 | 7817 | GTCN_223 | 1707 | ATCN_1538 | 7860 |
| TTCN_392 | 1665 | GTCN_1258 | 7818 | CTCN_429 | 1708 | CTCN_2266 | 7861 |
| GTCN_211 | 1666 | CTCN_2251 | 7819 | GTCN_224 | 1709 | TTCN_2242 | 7862 |
| GTCN_212 | 1667 | TTCN_2230 | 7820 | CTCN_430 | 1710 | TTCN_2243 | 7863 |
| GTCN_213 | 1668 | TTCN_2231 | 7821 | ATCN_283 | 1711 | CTCN_2267 | 7864 |
| ATCN_276 | 1669 | TTCN_2232 | 7822 | ATCN_284 | 1712 | CTCN_2268 | 7865 |
| TTCN_393 | 1670 | TTCN_2233 | 7823 | CTCN_431 | 1713 | TTCN_2244 | 7866 |
| CTCN_415 | 1671 | CTCN_2252 | 7824 | CTCN_432 | 1714 | GTCN_1263 | 7867 |
| ATCN_277 | 1672 | ATCN_1528 | 7825 | CTCN_433 | 1715 | TTCN_2245 | 7868 |
| CTCN_416 | 1673 | TTCN_2234 | 7826 | TTCN_401 | 1716 | ATCN_1539 | 7869 |
| GTCN_214 | 1674 | ATCN_1529 | 7827 | ATCN_285 | 1717 | ATCN_1540 | 7870 |
| CTCN_417 | 1675 | TTCN_2235 | 7828 | TTCN_402 | 1718 | CTCN_2269 | 7871 |
| CTCN_418 | 1676 | GTCN_1259 | 7829 | TTCN_403 | 1719 | TTCN_2246 | 7872 |
| GTCN_215 | 1677 | CTCN_2253 | 7830 | GTCN_225 | 1720 | TTCN_2247 | 7873 |
| CTCN_419 | 1678 | ATCN_1530 | 7831 | TTCN_404 | 1721 | GTCN_1264 | 7874 |
| TTCN_394 | 1679 | CTCN_2254 | 7832 | CTCN_434 | 1722 | CTCN_2270 | 7875 |
| GTCN_216 | 1680 | CTCN_2255 | 7833 | TTCN_405 | 1723 | CTCN_2271 | 7876 |
| GTCN_217 | 1681 | ATCN_1531 | 7834 | CTCN_435 | 1724 | TTCN_2248 | 7877 |
| CTCN_420 | 1682 | CTCN_2256 | 7835 | GTCN_226 | 1725 | TTCN_2249 | 7878 |
| TTCN_395 | 1683 | ATCN_1532 | 7836 | GTCN_227 | 1726 | CTCN_2272 | 7879 |
| CTCN_421 | 1684 | ATCN_1533 | 7837 | TTCN_406 | 1727 | ATCN_1541 | 7880 |
| GTCN_218 | 1685 | TTCN_2236 | 7838 | CTCN_436 | 1728 | TTCN_2250 | 7881 |
| CTCN_422 | 1686 | GTCN_1260 | 7839 | CTCN_437 | 1729 | CTCN_2273 | 7882 |
| ATCN_278 | 1687 | CTCN_2257 | 7840 | CTCN_438 | 1730 | TTCN_2251 | 7883 |
| ATCN_279 | 1688 | TTCN_2237 | 7841 | ATCN_286 | 1731 | TTCN_2252 | 7884 |
| CTCN_423 | 1689 | CTCN_2258 | 7842 | TTCN_407 | 1732 | ATCN_1542 | 7885 |
| ATCN_280 | 1690 | TTCN_2238 | 7843 | TTCN_408 | 1733 | TTCN_2253 | 7886 |
| ATCN_281 | 1691 | CTCN_2259 | 7844 | TTCN_409 | 1734 | ATCN_1543 | 7887 |
| TTCN_396 | 1692 | GTCN_1261 | 7845 | CTCN_439 | 1735 | ATCN_1544 | 7888 |
| CTCN_424 | 1693 | TTCN_2239 | 7846 | ATCN_287 | 1736 | GTCN_1265 | 7889 |
| TTCN_397 | 1694 | CTCN_2260 | 7847 | TTCN_410 | 1737 | CTCN_2274 | 7890 |
| GTCN_219 | 1695 | ATCN_1534 | 7848 | TTCN_411 | 1738 | CTCN_2275 | 7891 |
| ATCN_282 | 1696 | ATCN_1535 | 7849 | CTCN_440 | 1739 | GTCN_1266 | 7892 |
| GTCN_220 | 1697 | ATCN_1536 | 7850 | GTCN_228 | 1740 | TTCN_2254 | 7893 |
| TTCN_398 | 1698 | ATCN_1537 | 7851 | TTCN_412 | 1741 | CTCN_2276 | 7894 |
| CTCN_425 | 1699 | GTCN_1262 | 7852 | CTCN_441 | 1742 | TTCN_2255 | 7895 |
| CTCN_426 | 1700 | CTCN_2261 | 7853 | GTCN_229 | 1743 | GTCN_1267 | 7896 |

FIG. 33 (continued)

| | | | | | | | |
|---|---|---|---|---|---|---|---|
| ATCN_288 | 1744 | TTCN_2256 | 7897 | TTCN_423 | 1787 | CTCN_2288 | 7940 |
| TTCN_413 | 1745 | TTCN_2257 | 7898 | TTCN_424 | 1788 | TTCN_2275 | 7941 |
| TTCN_414 | 1746 | TTCN_2258 | 7899 | TTCN_425 | 1789 | CTCN_2289 | 7942 |
| GTCN_230 | 1747 | TTCN_2259 | 7900 | ATCN_295 | 1790 | GTCN_1271 | 7943 |
| CTCN_442 | 1748 | ATCN_1545 | 7901 | ATCN_296 | 1791 | TTCN_2276 | 7944 |
| GTCN_231 | 1749 | ATCN_1546 | 7902 | TTCN_426 | 1792 | TTCN_2277 | 7945 |
| CTCN_443 | 1750 | TTCN_2260 | 7903 | CTCN_458 | 1793 | TTCN_2278 | 7946 |
| TTCN_415 | 1751 | CTCN_2277 | 7904 | GTCN_240 | 1794 | TTCN_2279 | 7947 |
| CTCN_444 | 1752 | TTCN_2261 | 7905 | ATCN_297 | 1795 | TTCN_2280 | 7948 |
| CTCN_445 | 1753 | CTCN_2278 | 7906 | CTCN_459 | 1796 | ATCN_1555 | 7949 |
| GTCN_232 | 1754 | ATCN_1547 | 7907 | ATCN_298 | 1797 | ATCN_1556 | 7950 |
| TTCN_416 | 1755 | GTCN_1268 | 7908 | CTCN_460 | 1798 | CTCN_2290 | 7951 |
| GTCN_233 | 1756 | CTCN_2279 | 7909 | ATCN_299 | 1799 | ATCN_1557 | 7952 |
| CTCN_446 | 1757 | ATCN_1548 | 7910 | GTCN_241 | 1800 | CTCN_2291 | 7953 |
| CTCN_447 | 1758 | CTCN_2280 | 7911 | CTCN_461 | 1801 | TTCN_2281 | 7954 |
| CTCN_448 | 1759 | TTCN_2262 | 7912 | GTCN_242 | 1802 | ATCN_1558 | 7955 |
| TTCN_417 | 1760 | ATCN_1549 | 7913 | ATCN_300 | 1803 | TTCN_2282 | 7956 |
| TTCN_418 | 1761 | CTCN_2281 | 7914 | CTCN_462 | 1804 | ATCN_1559 | 7957 |
| CTCN_449 | 1762 | CTCN_2282 | 7915 | TTCN_427 | 1805 | ATCN_1560 | 7958 |
| CTCN_450 | 1763 | TTCN_2263 | 7916 | CTCN_463 | 1806 | ATCN_1561 | 7959 |
| CTCN_451 | 1764 | TTCN_2264 | 7917 | ATCN_301 | 1807 | ATCN_1562 | 7960 |
| CTCN_452 | 1765 | CTCN_2283 | 7918 | GTCN_243 | 1808 | ATCN_1563 | 7961 |
| ATCN_289 | 1766 | CTCN_2284 | 7919 | ATCN_302 | 1809 | TTCN_2283 | 7962 |
| ATCN_290 | 1767 | GTCN_1269 | 7920 | CTCN_464 | 1810 | TTCN_2284 | 7963 |
| CTCN_453 | 1768 | TTCN_2265 | 7921 | TTCN_428 | 1811 | GTCN_1272 | 7964 |
| ATCN_291 | 1769 | TTCN_2266 | 7922 | CTCN_465 | 1812 | TTCN_2285 | 7965 |
| TTCN_419 | 1770 | ATCN_1550 | 7923 | CTCN_466 | 1813 | TTCN_2286 | 7966 |
| GTCN_234 | 1771 | TTCN_2267 | 7924 | ATCN_303 | 1814 | TTCN_2287 | 7967 |
| GTCN_235 | 1772 | CTCN_2285 | 7925 | ATCN_304 | 1815 | ATCN_1564 | 7968 |
| TTCN_420 | 1773 | GTCN_1270 | 7926 | ATCN_305 | 1816 | TTCN_2288 | 7969 |
| CTCN_454 | 1774 | TTCN_2268 | 7927 | TTCN_429 | 1817 | TTCN_2289 | 7970 |
| GTCN_236 | 1775 | CTCN_2286 | 7928 | TTCN_430 | 1818 | TTCN_2290 | 7971 |
| GTCN_237 | 1776 | TTCN_2269 | 7929 | CTCN_467 | 1819 | CTCN_2292 | 7972 |
| ATCN_292 | 1777 | ATCN_1551 | 7930 | TTCN_431 | 1820 | TTCN_2291 | 7973 |
| CTCN_455 | 1778 | TTCN_2270 | 7931 | TTCN_432 | 1821 | TTCN_2292 | 7974 |
| ATCN_293 | 1779 | TTCN_2271 | 7932 | CTCN_468 | 1822 | TTCN_2293 | 7975 |
| ATCN_294 | 1780 | CTCN_2287 | 7933 | TTCN_433 | 1823 | CTCN_2293 | 7976 |
| CTCN_456 | 1781 | TTCN_2272 | 7934 | TTCN_434 | 1824 | CTCN_2294 | 7977 |
| TTCN_421 | 1782 | TTCN_2273 | 7935 | TTCN_435 | 1825 | TTCN_2294 | 7978 |
| CTCN_457 | 1783 | TTCN_2274 | 7936 | TTCN_436 | 1826 | TTCN_2295 | 7979 |
| GTCN_238 | 1784 | ATCN_1552 | 7937 | CTCN_469 | 1827 | TTCN_2296 | 7980 |
| GTCN_239 | 1785 | ATCN_1553 | 7938 | TTCN_437 | 1828 | CTCN_2295 | 7981 |
| TTCN_422 | 1786 | ATCN_1554 | 7939 | TTCN_438 | 1829 | TTCN_2297 | 7982 |

FIG. 33 (continued)

| | | | | | | | | |
|---|---|---|---|---|---|---|---|---|
| CTCN_470 | 1830 | TTCN_2298 | 7983 | ATCN_312 | 1873 | ATCN_1577 | 8026 |
| CTCN_471 | 1831 | CTCN_2296 | 7984 | TTCN_448 | 1874 | TTCN_2315 | 8027 |
| CTCN_472 | 1832 | TTCN_2299 | 7985 | CTCN_489 | 1875 | ATCN_1578 | 8028 |
| TTCN_439 | 1833 | ATCN_1565 | 7986 | ATCN_313 | 1876 | TTCN_2316 | 8029 |
| GTCN_244 | 1834 | TTCN_2300 | 7987 | TTCN_449 | 1877 | CTCN_2306 | 8030 |
| CTCN_473 | 1835 | ATCN_1566 | 7988 | ATCN_314 | 1878 | ATCN_1579 | 8031 |
| TTCN_440 | 1836 | ATCN_1567 | 7989 | ATCN_315 | 1879 | ATCN_1580 | 8032 |
| TTCN_441 | 1837 | ATCN_1568 | 7990 | TTCN_450 | 1880 | TTCN_2317 | 8033 |
| GTCN_245 | 1838 | TTCN_2301 | 7991 | TTCN_451 | 1881 | TTCN_2318 | 8034 |
| GTCN_246 | 1839 | CTCN_2297 | 7992 | TTCN_452 | 1882 | ATCN_1581 | 8035 |
| TTCN_442 | 1840 | ATCN_1569 | 7993 | TTCN_453 | 1883 | TTCN_2319 | 8036 |
| GTCN_247 | 1841 | TTCN_2302 | 7994 | GTCN_253 | 1884 | TTCN_2320 | 8037 |
| ATCN_306 | 1842 | CTCN_2298 | 7995 | CTCN_490 | 1885 | GTCN_1277 | 8038 |
| GTCN_248 | 1843 | TTCN_2303 | 7996 | ATCN_316 | 1886 | ATCN_1582 | 8039 |
| TTCN_443 | 1844 | CTCN_2299 | 7997 | TTCN_454 | 1887 | ATCN_1583 | 8040 |
| GTCN_249 | 1845 | TTCN_2304 | 7998 | ATCN_317 | 1888 | CTCN_2307 | 8041 |
| CTCN_474 | 1846 | ATCN_1570 | 7999 | TTCN_455 | 1889 | CTCN_2308 | 8042 |
| CTCN_475 | 1847 | CTCN_2300 | 8000 | ATCN_318 | 1890 | CTCN_2309 | 8043 |
| ATCN_307 | 1848 | ATCN_1571 | 8001 | TTCN_456 | 1891 | TTCN_2321 | 8044 |
| CTCN_476 | 1849 | GTCN_1273 | 8002 | ATCN_319 | 1892 | CTCN_2310 | 8045 |
| TTCN_444 | 1850 | CTCN_2301 | 8003 | ATCN_320 | 1893 | ATCN_1584 | 8046 |
| CTCN_477 | 1851 | ATCN_1572 | 8004 | CTCN_491 | 1894 | GTCN_1278 | 8047 |
| TTCN_445 | 1852 | ATCN_1573 | 8005 | GTCN_254 | 1895 | CTCN_2311 | 8048 |
| CTCN_478 | 1853 | ATCN_1574 | 8006 | TTCN_457 | 1896 | CTCN_2312 | 8049 |
| TTCN_446 | 1854 | TTCN_2305 | 8007 | CTCN_492 | 1897 | CTCN_2313 | 8050 |
| CTCN_479 | 1855 | TTCN_2306 | 8008 | ATCN_321 | 1898 | ATCN_1585 | 8051 |
| CTCN_480 | 1856 | TTCN_2307 | 8009 | ATCN_322 | 1899 | TTCN_2322 | 8052 |
| CTCN_481 | 1857 | CTCN_2302 | 8010 | TTCN_458 | 1900 | TTCN_2323 | 8053 |
| CTCN_482 | 1858 | TTCN_2308 | 8011 | GTCN_255 | 1901 | GTCN_1279 | 8054 |
| CTCN_483 | 1859 | ATCN_1575 | 8012 | TTCN_459 | 1902 | CTCN_2314 | 8055 |
| GTCN_250 | 1860 | TTCN_2309 | 8013 | GTCN_256 | 1903 | CTCN_2315 | 8056 |
| CTCN_484 | 1861 | CTCN_2303 | 8014 | TTCN_460 | 1904 | GTCN_1280 | 8057 |
| CTCN_485 | 1862 | GTCN_1274 | 8015 | TTCN_461 | 1905 | CTCN_2316 | 8058 |
| ATCN_308 | 1863 | TTCN_2310 | 8016 | GTCN_257 | 1906 | TTCN_2324 | 8059 |
| CTCN_486 | 1864 | ATCN_1576 | 8017 | CTCN_493 | 1907 | CTCN_2317 | 8060 |
| CTCN_487 | 1865 | TTCN_2311 | 8018 | TTCN_462 | 1908 | GTCN_1281 | 8061 |
| CTCN_488 | 1866 | TTCN_2312 | 8019 | TTCN_463 | 1909 | TTCN_2325 | 8062 |
| GTCN_251 | 1867 | GTCN_1275 | 8020 | ATCN_323 | 1910 | TTCN_2326 | 8063 |
| ATCN_309 | 1868 | CTCN_2304 | 8021 | TTCN_464 | 1911 | GTCN_1282 | 8064 |
| TTCN_447 | 1869 | TTCN_2313 | 8022 | CTCN_494 | 1912 | TTCN_2327 | 8065 |
| ATCN_310 | 1870 | CTCN_2305 | 8023 | TTCN_465 | 1913 | CTCN_2318 | 8066 |
| GTCN_252 | 1871 | GTCN_1276 | 8024 | CTCN_495 | 1914 | TTCN_2328 | 8067 |
| ATCN_311 | 1872 | TTCN_2314 | 8025 | TTCN_466 | 1915 | TTCN_2329 | 8068 |

FIG. 33 (continued)

| | | | | | | | |
|---|---|---|---|---|---|---|---|
| GTCN_258 | 1916 | CTCN_2319 | 8069 | TTCN_487 | 1959 | ATCN_1596 | 8112 |
| CTCN_496 | 1917 | TTCN_2330 | 8070 | TTCN_488 | 1960 | TTCN_2355 | 8113 |
| TTCN_467 | 1918 | TTCN_2331 | 8071 | TTCN_489 | 1961 | ATCN_1597 | 8114 |
| TTCN_468 | 1919 | TTCN_2332 | 8072 | TTCN_490 | 1962 | ATCN_1598 | 8115 |
| CTCN_497 | 1920 | ATCN_1586 | 8073 | TTCN_491 | 1963 | ATCN_1599 | 8116 |
| CTCN_498 | 1921 | TTCN_2333 | 8074 | TTCN_492 | 1964 | TTCN_2356 | 8117 |
| GTCN_259 | 1922 | ATCN_1587 | 8075 | TTCN_493 | 1965 | ATCN_1600 | 8118 |
| TTCN_469 | 1923 | ATCN_1588 | 8076 | TTCN_494 | 1966 | TTCN_2357 | 8119 |
| TTCN_470 | 1924 | ATCN_1589 | 8077 | CTCN_508 | 1967 | ATCN_1601 | 8120 |
| GTCN_260 | 1925 | ATCN_1590 | 8078 | TTCN_495 | 1968 | TTCN_2358 | 8121 |
| CTCN_499 | 1926 | TTCN_2334 | 8079 | TTCN_496 | 1969 | ATCN_1602 | 8122 |
| TTCN_471 | 1927 | TTCN_2335 | 8080 | TTCN_497 | 1970 | ATCN_1603 | 8123 |
| CTCN_500 | 1928 | TTCN_2336 | 8081 | TTCN_498 | 1971 | ATCN_1604 | 8124 |
| GTCN_261 | 1929 | TTCN_2337 | 8082 | TTCN_499 | 1972 | TTCN_2359 | 8125 |
| TTCN_472 | 1930 | TTCN_2338 | 8083 | CTCN_509 | 1973 | TTCN_2360 | 8126 |
| TTCN_473 | 1931 | TTCN_2339 | 8084 | TTCN_500 | 1974 | GTCN_1286 | 8127 |
| ATCN_324 | 1932 | CTCN_2320 | 8085 | TTCN_501 | 1975 | TTCN_2361 | 8128 |
| CTCN_501 | 1933 | TTCN_2340 | 8086 | CTCN_510 | 1976 | CTCN_2324 | 8129 |
| TTCN_474 | 1934 | TTCN_2341 | 8087 | TTCN_502 | 1977 | GTCN_1287 | 8130 |
| ATCN_325 | 1935 | TTCN_2342 | 8088 | TTCN_503 | 1978 | ATCN_1605 | 8131 |
| ATCN_326 | 1936 | TTCN_2343 | 8089 | CTCN_511 | 1979 | TTCN_2362 | 8132 |
| CTCN_502 | 1937 | ATCN_1591 | 8090 | CTCN_512 | 1980 | ATCN_1606 | 8133 |
| CTCN_503 | 1938 | ATCN_1592 | 8091 | TTCN_504 | 1981 | ATCN_1607 | 8134 |
| CTCN_504 | 1939 | ATCN_1593 | 8092 | TTCN_505 | 1982 | CTCN_2325 | 8135 |
| TTCN_475 | 1940 | CTCN_2321 | 8093 | TTCN_506 | 1983 | GTCN_1288 | 8136 |
| CTCN_505 | 1941 | ATCN_1594 | 8094 | CTCN_513 | 1984 | TTCN_2363 | 8137 |
| TTCN_476 | 1942 | TTCN_2344 | 8095 | ATCN_329 | 1985 | GTCN_1289 | 8138 |
| TTCN_477 | 1943 | TTCN_2345 | 8096 | ATCN_330 | 1986 | CTCN_2326 | 8139 |
| TTCN_478 | 1944 | CTCN_2322 | 8097 | CTCN_514 | 1987 | TTCN_2364 | 8140 |
| CTCN_506 | 1945 | TTCN_2346 | 8098 | ATCN_331 | 1988 | ATCN_1608 | 8141 |
| TTCN_479 | 1946 | TTCN_2347 | 8099 | TTCN_507 | 1989 | ATCN_1609 | 8142 |
| ATCN_327 | 1947 | TTCN_2348 | 8100 | GTCN_264 | 1990 | CTCN_2327 | 8143 |
| GTCN_262 | 1948 | TTCN_2349 | 8101 | TTCN_508 | 1991 | CTCN_2328 | 8144 |
| CTCN_507 | 1949 | TTCN_2350 | 8102 | CTCN_515 | 1992 | ATCN_1610 | 8145 |
| GTCN_263 | 1950 | GTCN_1283 | 8103 | GTCN_265 | 1993 | GTCN_1290 | 8146 |
| ATCN_328 | 1951 | GTCN_1284 | 8104 | TTCN_509 | 1994 | ATCN_1611 | 8147 |
| TTCN_480 | 1952 | TTCN_2351 | 8105 | CTCN_516 | 1995 | CTCN_2329 | 8148 |
| TTCN_481 | 1953 | CTCN_2323 | 8106 | ATCN_332 | 1996 | TTCN_2365 | 8149 |
| TTCN_482 | 1954 | ATCN_1595 | 8107 | GTCN_266 | 1997 | ATCN_1612 | 8150 |
| TTCN_483 | 1955 | TTCN_2352 | 8108 | TTCN_510 | 1998 | TTCN_2366 | 8151 |
| TTCN_484 | 1956 | GTCN_1285 | 8109 | TTCN_511 | 1999 | GTCN_1291 | 8152 |
| TTCN_485 | 1957 | TTCN_2353 | 8110 | ATCN_333 | 2000 | CTCN_2330 | 8153 |
| TTCN_486 | 1958 | TTCN_2354 | 8111 | GTCN_267 | 2001 | TTCN_2367 | 8154 |

FIG. 33 (continued)

| | | | | | | | |
|---|---|---|---|---|---|---|---|
| CTCN_517 | 2002 | TTCN_2368 | 8155 | TTCN_520 | 2045 | CTCN_2340 | 8198 |
| TTCN_512 | 2003 | CTCN_2331 | 8156 | TTCN_521 | 2046 | GTCN_1294 | 8199 |
| TTCN_513 | 2004 | TTCN_2369 | 8157 | CTCN_532 | 2047 | ATCN_1625 | 8200 |
| ATCN_334 | 2005 | GTCN_1292 | 8158 | CTCN_533 | 2048 | ATCN_1626 | 8201 |
| GTCN_268 | 2006 | TTCN_2370 | 8159 | CTCN_534 | 2049 | ATCN_1627 | 8202 |
| ATCN_335 | 2007 | TTCN_2371 | 8160 | CTCN_535 | 2050 | CTCN_2341 | 8203 |
| ATCN_336 | 2008 | ATCN_1613 | 8161 | TTCN_522 | 2051 | TTCN_2388 | 8204 |
| TTCN_514 | 2009 | ATCN_1614 | 8162 | CTCN_536 | 2052 | ATCN_1628 | 8205 |
| GTCN_269 | 2010 | ATCN_1615 | 8163 | CTCN_537 | 2053 | TTCN_2389 | 8206 |
| GTCN_270 | 2011 | TTCN_2372 | 8164 | CTCN_538 | 2054 | TTCN_2390 | 8207 |
| CTCN_518 | 2012 | TTCN_2373 | 8165 | TTCN_523 | 2055 | CTCN_2342 | 8208 |
| CTCN_519 | 2013 | TTCN_2374 | 8166 | ATCN_345 | 2056 | GTCN_1295 | 8209 |
| TTCN_515 | 2014 | CTCN_2332 | 8167 | ATCN_346 | 2057 | TTCN_2391 | 8210 |
| GTCN_271 | 2015 | ATCN_1616 | 8168 | GTCN_277 | 2058 | TTCN_2392 | 8211 |
| CTCN_520 | 2016 | TTCN_2375 | 8169 | TTCN_524 | 2059 | ATCN_1629 | 8212 |
| CTCN_521 | 2017 | CTCN_2333 | 8170 | GTCN_278 | 2060 | ATCN_1630 | 8213 |
| CTCN_522 | 2018 | TTCN_2376 | 8171 | TTCN_525 | 2061 | TTCN_2393 | 8214 |
| GTCN_272 | 2019 | TTCN_2377 | 8172 | TTCN_526 | 2062 | CTCN_2343 | 8215 |
| CTCN_523 | 2020 | TTCN_2378 | 8173 | TTCN_527 | 2063 | GTCN_1296 | 8216 |
| TTCN_516 | 2021 | ATCN_1617 | 8174 | TTCN_528 | 2064 | CTCN_2344 | 8217 |
| TTCN_517 | 2022 | TTCN_2379 | 8175 | TTCN_529 | 2065 | CTCN_2345 | 8218 |
| GTCN_273 | 2023 | TTCN_2380 | 8176 | CTCN_539 | 2066 | TTCN_2394 | 8219 |
| CTCN_524 | 2024 | CTCN_2334 | 8177 | CTCN_540 | 2067 | ATCN_1631 | 8220 |
| TTCN_518 | 2025 | CTCN_2335 | 8178 | CTCN_541 | 2068 | ATCN_1632 | 8221 |
| CTCN_525 | 2026 | GTCN_1293 | 8179 | ATCN_347 | 2069 | ATCN_1633 | 8222 |
| ATCN_337 | 2027 | TTCN_2381 | 8180 | ATCN_348 | 2070 | GTCN_1297 | 8223 |
| CTCN_526 | 2028 | TTCN_2382 | 8181 | GTCN_279 | 2071 | TTCN_2395 | 8224 |
| ATCN_338 | 2029 | CTCN_2336 | 8182 | TTCN_530 | 2072 | CTCN_2346 | 8225 |
| GTCN_274 | 2030 | ATCN_1618 | 8183 | ATCN_349 | 2073 | ATCN_1634 | 8226 |
| GTCN_275 | 2031 | TTCN_2383 | 8184 | ATCN_350 | 2074 | TTCN_2396 | 8227 |
| CTCN_527 | 2032 | ATCN_1619 | 8185 | TTCN_531 | 2075 | ATCN_1635 | 8228 |
| ATCN_339 | 2033 | ATCN_1620 | 8186 | TTCN_532 | 2076 | ATCN_1636 | 8229 |
| GTCN_276 | 2034 | TTCN_2384 | 8187 | TTCN_533 | 2077 | ATCN_1637 | 8230 |
| ATCN_340 | 2035 | ATCN_1621 | 8188 | TTCN_534 | 2078 | ATCN_1638 | 8231 |
| CTCN_528 | 2036 | ATCN_1622 | 8189 | CTCN_542 | 2079 | CTCN_2347 | 8232 |
| ATCN_341 | 2037 | TTCN_2385 | 8190 | CTCN_543 | 2080 | TTCN_2397 | 8233 |
| ATCN_342 | 2038 | ATCN_1623 | 8191 | ATCN_351 | 2081 | ATCN_1639 | 8234 |
| CTCN_529 | 2039 | ATCN_1624 | 8192 | TTCN_535 | 2082 | CTCN_2348 | 8235 |
| CTCN_530 | 2040 | CTCN_2337 | 8193 | TTCN_536 | 2083 | GTCN_1298 | 8236 |
| ATCN_343 | 2041 | TTCN_2386 | 8194 | CTCN_544 | 2084 | ATCN_1640 | 8237 |
| ATCN_344 | 2042 | CTCN_2338 | 8195 | CTCN_545 | 2085 | TTCN_2398 | 8238 |
| CTCN_531 | 2043 | TTCN_2387 | 8196 | CTCN_546 | 2086 | CTCN_2349 | 8239 |
| TTCN_519 | 2044 | CTCN_2339 | 8197 | CTCN_547 | 2087 | CTCN_2350 | 8240 |

FIG. 33 (continued)

| | | | | | | | |
|---|---|---|---|---|---|---|---|
| ATCN_352 | 2088 | GTCN_1299 | 8241 | ATCN_362 | 2311 | GTCN_1306 | 8284 |
| GTCN_280 | 2089 | CTCN_2351 | 8242 | CTCN_552 | 2312 | ATCN_1652 | 8285 |
| TTCN_537 | 2090 | ATCN_1641 | 8243 | TTCN_558 | 2313 | GTCN_1307 | 8286 |
| CTCN_548 | 2091 | ATCN_1642 | 8244 | GTCN_288 | 2314 | TTCN_2410 | 8287 |
| ATCN_353 | 2092 | GTCN_1300 | 8245 | TTCN_559 | 2315 | CTCN_2365 | 8288 |
| ATCN_354 | 2093 | ATCN_1643 | 8246 | ATCN_363 | 2316 | ATCN_1653 | 8289 |
| GTCN_281 | 2094 | TTCN_2399 | 8247 | TTCN_560 | 2317 | ATCN_1654 | 8290 |
| ATCN_355 | 2095 | GTCN_1301 | 8248 | TTCN_561 | 2318 | ATCN_1655 | 8291 |
| TTCN_538 | 2096 | CTCN_2352 | 8249 | TTCN_562 | 2319 | GTCN_1308 | 8292 |
| TTCN_539 | 2097 | TTCN_2400 | 8250 | TTCN_563 | 2320 | GTCN_1309 | 8293 |
| ATCN_356 | 2098 | ATCN_1644 | 8251 | GTCN_289 | 2321 | TTCN_2411 | 8294 |
| TTCN_540 | 2099 | GTCN_1302 | 8252 | CTCN_553 | 2322 | CTCN_2366 | 8295 |
| TTCN_541 | 2100 | TTCN_2401 | 8253 | CTCN_554 | 2323 | CTCN_2367 | 8296 |
| CTCN_549 | 2281 | CTCN_2353 | 8254 | CTCN_555 | 2324 | ATCN_1656 | 8297 |
| TTCN_542 | 2282 | CTCN_2354 | 8255 | TTCN_564 | 2325 | CTCN_2368 | 8298 |
| TTCN_543 | 2283 | TTCN_2402 | 8256 | TTCN_565 | 2326 | TTCN_2412 | 8299 |
| ATCN_357 | 2284 | ATCN_1645 | 8257 | CTCN_556 | 2327 | TTCN_2413 | 8300 |
| TTCN_544 | 2285 | TTCN_2403 | 8258 | ATCN_364 | 2328 | ATCN_1657 | 8301 |
| GTCN_282 | 2286 | CTCN_2355 | 8259 | TTCN_566 | 2329 | TTCN_2414 | 8302 |
| TTCN_545 | 2287 | CTCN_2356 | 8260 | GTCN_290 | 2330 | GTCN_1310 | 8303 |
| ATCN_358 | 2288 | CTCN_2357 | 8261 | TTCN_567 | 2331 | TTCN_2415 | 8304 |
| TTCN_546 | 2289 | ATCN_1646 | 8262 | CTCN_557 | 2332 | CTCN_2369 | 8305 |
| TTCN_547 | 2290 | CTCN_2358 | 8263 | GTCN_291 | 2333 | TTCN_2416 | 8306 |
| TTCN_548 | 2291 | ATCN_1647 | 8264 | ATCN_365 | 2334 | ATCN_1658 | 8307 |
| GTCN_283 | 2292 | CTCN_2359 | 8265 | TTCN_568 | 2335 | TTCN_2417 | 8308 |
| TTCN_549 | 2293 | GTCN_1303 | 8266 | ATCN_366 | 2336 | CTCN_2370 | 8309 |
| TTCN_550 | 2294 | CTCN_2360 | 8267 | ATCN_367 | 2337 | CTCN_2371 | 8310 |
| GTCN_284 | 2295 | CTCN_2361 | 8268 | TTCN_569 | 2338 | TTCN_2418 | 8311 |
| ATCN_359 | 2296 | GTCN_1304 | 8269 | CTCN_558 | 2339 | ATCN_1659 | 8312 |
| CTCN_550 | 2297 | ATCN_1648 | 8270 | CTCN_559 | 2340 | TTCN_2419 | 8313 |
| GTCN_285 | 2298 | CTCN_2362 | 8271 | GTCN_292 | 2341 | ATCN_1660 | 8314 |
| CTCN_551 | 2299 | TTCN_2404 | 8272 | CTCN_560 | 2342 | TTCN_2420 | 8315 |
| TTCN_551 | 2300 | CTCN_2363 | 8273 | TTCN_570 | 2343 | ATCN_1661 | 8316 |
| ATCN_360 | 2301 | GTCN_1305 | 8274 | CTCN_561 | 2344 | ATCN_1662 | 8317 |
| TTCN_552 | 2302 | TTCN_2405 | 8275 | TTCN_571 | 2345 | ATCN_1663 | 8318 |
| GTCN_286 | 2303 | ATCN_1649 | 8276 | TTCN_572 | 2346 | ATCN_1664 | 8319 |
| TTCN_553 | 2304 | ATCN_1650 | 8277 | ATCN_368 | 2347 | GTCN_1311 | 8320 |
| TTCN_554 | 2305 | TTCN_2406 | 8278 | TTCN_573 | 2348 | TTCN_2421 | 8321 |
| GTCN_287 | 2306 | TTCN_2407 | 8279 | CTCN_562 | 2349 | ATCN_1665 | 8322 |
| TTCN_555 | 2307 | ATCN_1651 | 8280 | ATCN_369 | 2350 | ATCN_1666 | 8323 |
| TTCN_556 | 2308 | TTCN_2408 | 8281 | ATCN_370 | 2351 | GTCN_1312 | 8324 |
| TTCN_557 | 2309 | TTCN_2409 | 8282 | ATCN_371 | 2352 | ATCN_1667 | 8325 |
| ATCN_361 | 2310 | CTCN_2364 | 8283 | ATCN_372 | 2353 | TTCN_2422 | 8326 |

FIG. 33 (continued)

| TTCN_574 | 2354 | TTCN_2423 | 8327 | ATCN_381 | 2397 | CTCN_2378 | 8370 |
|---|---|---|---|---|---|---|---|
| CTCN_563 | 2355 | CTCN_2372 | 8328 | CTCN_581 | 2398 | TTCN_2447 | 8371 |
| GTCN_293 | 2356 | TTCN_2424 | 8329 | CTCN_582 | 2399 | ATCN_1674 | 8372 |
| ATCN_373 | 2357 | CTCN_2373 | 8330 | GTCN_301 | 2400 | GTCN_1320 | 8373 |
| CTCN_564 | 2358 | GTCN_1313 | 8331 | CTCN_583 | 2401 | GTCN_1321 | 8374 |
| GTCN_294 | 2359 | TTCN_2425 | 8332 | GTCN_302 | 2402 | ATCN_1675 | 8375 |
| TTCN_575 | 2360 | ATCN_1668 | 8333 | CTCN_584 | 2403 | ATCN_1676 | 8376 |
| CTCN_565 | 2361 | TTCN_2426 | 8334 | GTCN_303 | 2404 | GTCN_1322 | 8377 |
| TTCN_576 | 2362 | TTCN_2427 | 8335 | TTCN_583 | 2405 | ATCN_1677 | 8378 |
| TTCN_577 | 2363 | GTCN_1314 | 8336 | ATCN_382 | 2406 | TTCN_2448 | 8379 |
| CTCN_566 | 2364 | GTCN_1315 | 8337 | ATCN_383 | 2407 | TTCN_2449 | 8380 |
| CTCN_567 | 2365 | TTCN_2428 | 8338 | TTCN_584 | 2408 | TTCN_2450 | 8381 |
| GTCN_295 | 2366 | TTCN_2429 | 8339 | ATCN_384 | 2409 | TTCN_2451 | 8382 |
| ATCN_374 | 2367 | TTCN_2430 | 8340 | TTCN_585 | 2410 | CTCN_2379 | 8383 |
| CTCN_568 | 2368 | TTCN_2431 | 8341 | CTCN_585 | 2411 | GTCN_1323 | 8384 |
| ATCN_375 | 2369 | CTCN_2374 | 8342 | TTCN_586 | 2412 | TTCN_2452 | 8385 |
| CTCN_569 | 2370 | GTCN_1316 | 8343 | CTCN_586 | 2413 | CTCN_2380 | 8386 |
| CTCN_570 | 2371 | TTCN_2432 | 8344 | ATCN_385 | 2414 | ATCN_1678 | 8387 |
| ATCN_376 | 2372 | TTCN_2433 | 8345 | GTCN_304 | 2415 | ATCN_1679 | 8388 |
| ATCN_377 | 2373 | TTCN_2434 | 8346 | TTCN_587 | 2416 | CTCN_2381 | 8389 |
| GTCN_296 | 2374 | TTCN_2435 | 8347 | GTCN_305 | 2417 | TTCN_2453 | 8390 |
| CTCN_571 | 2375 | GTCN_1317 | 8348 | ATCN_386 | 2418 | ATCN_1680 | 8391 |
| TTCN_578 | 2376 | TTCN_2436 | 8349 | ATCN_387 | 2419 | TTCN_2454 | 8392 |
| CTCN_572 | 2377 | TTCN_2437 | 8350 | GTCN_306 | 2420 | GTCN_1324 | 8393 |
| GTCN_297 | 2378 | ATCN_1669 | 8351 | TTCN_588 | 2421 | TTCN_2455 | 8394 |
| TTCN_579 | 2379 | TTCN_2438 | 8352 | ATCN_388 | 2422 | GTCN_1325 | 8395 |
| GTCN_298 | 2380 | TTCN_2439 | 8353 | CTCN_587 | 2423 | ATCN_1681 | 8396 |
| TTCN_580 | 2381 | TTCN_2440 | 8354 | GTCN_307 | 2424 | TTCN_2456 | 8397 |
| GTCN_299 | 2382 | TTCN_2441 | 8355 | CTCN_588 | 2425 | TTCN_2457 | 8398 |
| CTCN_573 | 2383 | TTCN_2442 | 8356 | CTCN_589 | 2426 | CTCN_2382 | 8399 |
| GTCN_300 | 2384 | ATCN_1670 | 8357 | CTCN_590 | 2427 | CTCN_2383 | 8400 |
| CTCN_574 | 2385 | ATCN_1671 | 8358 | CTCN_591 | 2428 | TTCN_2458 | 8401 |
| CTCN_575 | 2386 | ATCN_1672 | 8359 | CTCN_592 | 2429 | CTCN_2384 | 8402 |
| CTCN_576 | 2387 | TTCN_2443 | 8360 | TTCN_589 | 2430 | ATCN_1682 | 8403 |
| TTCN_581 | 2388 | TTCN_2444 | 8361 | CTCN_593 | 2431 | ATCN_1683 | 8404 |
| ATCN_378 | 2389 | GTCN_1318 | 8362 | GTCN_308 | 2432 | TTCN_2459 | 8405 |
| TTCN_582 | 2390 | TTCN_2445 | 8363 | CTCN_594 | 2433 | CTCN_2385 | 8406 |
| CTCN_577 | 2391 | CTCN_2375 | 8364 | ATCN_389 | 2434 | TTCN_2460 | 8407 |
| CTCN_578 | 2392 | TTCN_2446 | 8365 | GTCN_309 | 2435 | TTCN_2461 | 8408 |
| CTCN_579 | 2393 | CTCN_2376 | 8366 | ATCN_390 | 2436 | GTCN_1326 | 8409 |
| ATCN_379 | 2394 | CTCN_2377 | 8367 | TTCN_590 | 2437 | ATCN_1684 | 8410 |
| ATCN_380 | 2395 | GTCN_1319 | 8368 | GTCN_310 | 2438 | GTCN_1327 | 8411 |
| CTCN_580 | 2396 | ATCN_1673 | 8369 | CTCN_595 | 2439 | ATCN_1685 | 8412 |

FIG. 33 (continued)

| | | | | | | | |
|---|---|---|---|---|---|---|---|
| CTCN_596 | 2440 | ATCN_1686 | 8413 | TTCN_610 | 2483 | TTCN_2477 | 8456 |
| CTCN_597 | 2441 | TTCN_2462 | 8414 | ATCN_394 | 2484 | TTCN_2478 | 8457 |
| CTCN_598 | 2442 | ATCN_1687 | 8415 | ATCN_395 | 2485 | TTCN_2479 | 8458 |
| GTCN_311 | 2443 | ATCN_1688 | 8416 | ATCN_396 | 2486 | TTCN_2480 | 8459 |
| CTCN_599 | 2444 | TTCN_2463 | 8417 | TTCN_611 | 2487 | GTCN_1332 | 8460 |
| TTCN_591 | 2445 | TTCN_2464 | 8418 | CTCN_608 | 2488 | CTCN_2392 | 8461 |
| GTCN_312 | 2446 | ATCN_1689 | 8419 | GTCN_320 | 2489 | GTCN_1333 | 8462 |
| GTCN_313 | 2447 | ATCN_1690 | 8420 | GTCN_321 | 2490 | CTCN_2393 | 8463 |
| CTCN_600 | 2448 | TTCN_2465 | 8421 | TTCN_612 | 2491 | GTCN_1334 | 8464 |
| TTCN_592 | 2449 | ATCN_1691 | 8422 | CTCN_609 | 2492 | ATCN_1704 | 8465 |
| GTCN_314 | 2450 | TTCN_2466 | 8423 | GTCN_322 | 2493 | CTCN_2394 | 8466 |
| ATCN_391 | 2451 | ATCN_1692 | 8424 | CTCN_610 | 2494 | CTCN_2395 | 8467 |
| TTCN_593 | 2452 | TTCN_2467 | 8425 | GTCN_323 | 2495 | ATCN_1705 | 8468 |
| TTCN_594 | 2453 | ATCN_1693 | 8426 | TTCN_613 | 2496 | TTCN_2481 | 8469 |
| CTCN_601 | 2454 | ATCN_1694 | 8427 | ATCN_397 | 2497 | TTCN_2482 | 8470 |
| GTCN_315 | 2455 | TTCN_2468 | 8428 | TTCN_614 | 2498 | CTCN_2396 | 8471 |
| GTCN_316 | 2456 | TTCN_2469 | 8429 | CTCN_611 | 2499 | ATCN_1706 | 8472 |
| TTCN_595 | 2457 | GTCN_1328 | 8430 | CTCN_612 | 2500 | TTCN_2483 | 8473 |
| TTCN_596 | 2458 | TTCN_2470 | 8431 | ATCN_398 | 2501 | TTCN_2484 | 8474 |
| TTCN_597 | 2459 | TTCN_2471 | 8432 | CTCN_613 | 2502 | CTCN_2397 | 8475 |
| ATCN_392 | 2460 | ATCN_1695 | 8433 | ATCN_399 | 2503 | GTCN_1335 | 8476 |
| GTCN_317 | 2461 | GTCN_1329 | 8434 | TTCN_615 | 2504 | TTCN_2485 | 8477 |
| TTCN_598 | 2462 | TTCN_2472 | 8435 | CTCN_614 | 2505 | CTCN_2398 | 8478 |
| TTCN_599 | 2463 | TTCN_2473 | 8436 | TTCN_616 | 2506 | CTCN_2399 | 8479 |
| TTCN_600 | 2464 | GTCN_1330 | 8437 | TTCN_617 | 2507 | ATCN_1707 | 8480 |
| GTCN_318 | 2465 | CTCN_2386 | 8438 | TTCN_618 | 2508 | TTCN_2486 | 8481 |
| CTCN_602 | 2466 | TTCN_2474 | 8439 | TTCN_619 | 2509 | ATCN_1708 | 8482 |
| CTCN_603 | 2467 | CTCN_2387 | 8440 | CTCN_615 | 2510 | TTCN_2487 | 8483 |
| CTCN_604 | 2468 | ATCN_1696 | 8441 | CTCN_616 | 2511 | TTCN_2488 | 8484 |
| TTCN_601 | 2469 | TTCN_2475 | 8442 | ATCN_400 | 2512 | ATCN_1709 | 8485 |
| TTCN_602 | 2470 | ATCN_1697 | 8443 | GTCN_324 | 2513 | GTCN_1336 | 8486 |
| TTCN_603 | 2471 | CTCN_2388 | 8444 | TTCN_620 | 2514 | ATCN_1710 | 8487 |
| CTCN_605 | 2472 | ATCN_1698 | 8445 | CTCN_617 | 2515 | TTCN_2489 | 8488 |
| CTCN_606 | 2473 | ATCN_1699 | 8446 | GTCN_325 | 2516 | CTCN_2400 | 8489 |
| TTCN_604 | 2474 | ATCN_1700 | 8447 | CTCN_618 | 2517 | ATCN_1711 | 8490 |
| TTCN_605 | 2475 | ATCN_1701 | 8448 | GTCN_326 | 2518 | ATCN_1712 | 8491 |
| TTCN_606 | 2476 | CTCN_2389 | 8449 | CTCN_619 | 2519 | ATCN_1713 | 8492 |
| ATCN_393 | 2477 | ATCN_1702 | 8450 | CTCN_620 | 2520 | GTCN_1337 | 8493 |
| TTCN_607 | 2478 | TTCN_2476 | 8451 | GTCN_327 | 2521 | ATCN_1714 | 8494 |
| CTCN_607 | 2479 | CTCN_2390 | 8452 | CTCN_621 | 2522 | ATCN_1715 | 8495 |
| GTCN_319 | 2480 | ATCN_1703 | 8453 | ATCN_401 | 2523 | ATCN_1716 | 8496 |
| TTCN_608 | 2481 | GTCN_1331 | 8454 | GTCN_328 | 2524 | TTCN_2490 | 8497 |
| TTCN_609 | 2482 | CTCN_2391 | 8455 | CTCN_622 | 2525 | ATCN_1717 | 8498 |

FIG. 33 (continued)

| | | | | | | | |
|---|---|---|---|---|---|---|---|
| CTCN_623 | 2526 | CTCN_2401 | 8499 | CTCN_637 | 2569 | GTCN_1344 | 8542 |
| CTCN_624 | 2527 | CTCN_2402 | 8500 | TTCN_632 | 2570 | CTCN_2411 | 8543 |
| TTCN_621 | 2528 | CTCN_2403 | 8501 | TTCN_633 | 2571 | ATCN_1730 | 8544 |
| TTCN_622 | 2529 | CTCN_2404 | 8502 | TTCN_634 | 2572 | TTCN_2506 | 8545 |
| CTCN_625 | 2530 | TTCN_2491 | 8503 | GTCN_340 | 2573 | CTCN_2412 | 8546 |
| CTCN_626 | 2531 | CTCN_2405 | 8504 | TTCN_635 | 2574 | CTCN_2413 | 8547 |
| CTCN_627 | 2532 | TTCN_2492 | 8505 | CTCN_638 | 2575 | ATCN_1731 | 8548 |
| GTCN_329 | 2533 | TTCN_2493 | 8506 | TTCN_636 | 2576 | ATCN_1732 | 8549 |
| CTCN_628 | 2534 | ATCN_1718 | 8507 | TTCN_637 | 2577 | GTCN_1345 | 8550 |
| CTCN_629 | 2535 | ATCN_1719 | 8508 | TTCN_638 | 2578 | CTCN_2414 | 8551 |
| GTCN_330 | 2536 | ATCN_1720 | 8509 | TTCN_639 | 2579 | TTCN_2507 | 8552 |
| TTCN_623 | 2537 | TTCN_2494 | 8510 | TTCN_640 | 2580 | ATCN_1733 | 8553 |
| ATCN_402 | 2538 | TTCN_2495 | 8511 | ATCN_409 | 2581 | ATCN_1734 | 8554 |
| GTCN_331 | 2539 | GTCN_1338 | 8512 | CTCN_639 | 2582 | TTCN_2508 | 8555 |
| CTCN_630 | 2540 | TTCN_2496 | 8513 | GTCN_341 | 2583 | CTCN_2415 | 8556 |
| ATCN_403 | 2541 | ATCN_1721 | 8514 | TTCN_641 | 2584 | GTCN_1346 | 8557 |
| CTCN_631 | 2542 | ATCN_1722 | 8515 | CTCN_640 | 2585 | TTCN_2509 | 8558 |
| GTCN_332 | 2543 | GTCN_1339 | 8516 | GTCN_342 | 2586 | ATCN_1735 | 8559 |
| CTCN_632 | 2544 | GTCN_1340 | 8517 | TTCN_642 | 2587 | ATCN_1736 | 8560 |
| ATCN_404 | 2545 | CTCN_2406 | 8518 | ATCN_410 | 2588 | TTCN_2510 | 8561 |
| ATCN_405 | 2546 | TTCN_2497 | 8519 | TTCN_643 | 2589 | ATCN_1737 | 8562 |
| TTCN_624 | 2547 | TTCN_2498 | 8520 | TTCN_644 | 2590 | TTCN_2511 | 8563 |
| ATCN_406 | 2548 | ATCN_1723 | 8521 | TTCN_645 | 2591 | TTCN_2512 | 8564 |
| CTCN_633 | 2549 | CTCN_2407 | 8522 | ATCN_411 | 2592 | CTCN_2416 | 8565 |
| CTCN_634 | 2550 | TTCN_2499 | 8523 | ATCN_412 | 2593 | ATCN_1738 | 8566 |
| GTCN_333 | 2551 | CTCN_2408 | 8524 | TTCN_646 | 2594 | TTCN_2513 | 8567 |
| TTCN_625 | 2552 | GTCN_1341 | 8525 | ATCN_413 | 2595 | CTCN_2417 | 8568 |
| TTCN_626 | 2553 | TTCN_2500 | 8526 | TTCN_647 | 2596 | TTCN_2514 | 8569 |
| TTCN_627 | 2554 | TTCN_2501 | 8527 | CTCN_641 | 2597 | GTCN_1347 | 8570 |
| TTCN_628 | 2555 | CTCN_2409 | 8528 | TTCN_648 | 2598 | GTCN_1348 | 8571 |
| ATCN_407 | 2556 | TTCN_2502 | 8529 | TTCN_649 | 2599 | CTCN_2418 | 8572 |
| GTCN_334 | 2557 | CTCN_2410 | 8530 | TTCN_650 | 2600 | TTCN_2515 | 8573 |
| CTCN_635 | 2558 | ATCN_1724 | 8531 | TTCN_651 | 2601 | CTCN_2419 | 8574 |
| CTCN_636 | 2559 | ATCN_1725 | 8532 | GTCN_343 | 2602 | GTCN_1349 | 8575 |
| ATCN_408 | 2560 | TTCN_2503 | 8533 | TTCN_652 | 2603 | TTCN_2516 | 8576 |
| TTCN_629 | 2561 | ATCN_1726 | 8534 | GTCN_344 | 2604 | ATCN_1739 | 8577 |
| GTCN_335 | 2562 | TTCN_2504 | 8535 | CTCN_642 | 2605 | TTCN_2517 | 8578 |
| TTCN_630 | 2563 | ATCN_1727 | 8536 | TTCN_653 | 2606 | ATCN_1740 | 8579 |
| GTCN_336 | 2564 | ATCN_1728 | 8537 | CTCN_643 | 2607 | GTCN_1350 | 8580 |
| TTCN_631 | 2565 | TTCN_2505 | 8538 | CTCN_644 | 2608 | GTCN_1351 | 8581 |
| GTCN_337 | 2566 | GTCN_1342 | 8539 | TTCN_654 | 2609 | TTCN_2518 | 8582 |
| GTCN_338 | 2567 | GTCN_1343 | 8540 | ATCN_414 | 2610 | ATCN_1741 | 8583 |
| GTCN_339 | 2568 | ATCN_1729 | 8541 | CTCN_645 | 2611 | TTCN_2519 | 8584 |

FIG. 33 (continued)

| | | | | | | | |
|---|---|---|---|---|---|---|---|
| CTCN_646 | 2612 | ATCN_1742 | 8585 | TTCN_672 | 2655 | CTCN_2438 | 8628 |
| TTCN_655 | 2613 | TTCN_2520 | 8586 | CTCN_656 | 2656 | CTCN_2439 | 8629 |
| GTCN_345 | 2614 | TTCN_2521 | 8587 | CTCN_657 | 2657 | TTCN_2531 | 8630 |
| GTCN_346 | 2615 | ATCN_1743 | 8588 | GTCN_354 | 2658 | GTCN_1356 | 8631 |
| TTCN_656 | 2616 | CTCN_2420 | 8589 | CTCN_658 | 2659 | CTCN_2440 | 8632 |
| CTCN_647 | 2617 | GTCN_1352 | 8590 | GTCN_355 | 2660 | TTCN_2532 | 8633 |
| ATCN_415 | 2618 | TTCN_2522 | 8591 | TTCN_673 | 2661 | CTCN_2441 | 8634 |
| GTCN_347 | 2619 | ATCN_1744 | 8592 | ATCN_422 | 2662 | CTCN_2442 | 8635 |
| TTCN_657 | 2620 | ATCN_1745 | 8593 | GTCN_356 | 2663 | TTCN_2533 | 8636 |
| TTCN_658 | 2621 | TTCN_2523 | 8594 | ATCN_423 | 2664 | CTCN_2443 | 8637 |
| TTCN_659 | 2622 | CTCN_2421 | 8595 | CTCN_659 | 2665 | CTCN_2444 | 8638 |
| CTCN_648 | 2623 | CTCN_2422 | 8596 | ATCN_424 | 2666 | GTCN_1357 | 8639 |
| TTCN_660 | 2624 | CTCN_2423 | 8597 | ATCN_425 | 2667 | ATCN_1752 | 8640 |
| TTCN_661 | 2625 | CTCN_2424 | 8598 | ATCN_426 | 2668 | GTCN_1358 | 8641 |
| CTCN_649 | 2626 | CTCN_2425 | 8599 | GTCN_357 | 2669 | TTCN_2534 | 8642 |
| TTCN_662 | 2627 | ATCN_1746 | 8600 | TTCN_674 | 2670 | TTCN_2535 | 8643 |
| GTCN_348 | 2628 | TTCN_2524 | 8601 | TTCN_675 | 2671 | ATCN_1753 | 8644 |
| TTCN_663 | 2629 | ATCN_1747 | 8602 | GTCN_358 | 2672 | TTCN_2536 | 8645 |
| TTCN_664 | 2630 | CTCN_2426 | 8603 | CTCN_660 | 2673 | ATCN_1754 | 8646 |
| TTCN_665 | 2631 | CTCN_2427 | 8604 | GTCN_359 | 2674 | GTCN_1359 | 8647 |
| GTCN_349 | 2632 | CTCN_2428 | 8605 | CTCN_661 | 2675 | CTCN_2445 | 8648 |
| ATCN_416 | 2633 | CTCN_2429 | 8606 | CTCN_662 | 2676 | ATCN_1755 | 8649 |
| CTCN_650 | 2634 | TTCN_2525 | 8607 | TTCN_676 | 2677 | ATCN_1756 | 8650 |
| ATCN_417 | 2635 | ATCN_1748 | 8608 | ATCN_427 | 2678 | CTCN_2446 | 8651 |
| TTCN_666 | 2636 | CTCN_2430 | 8609 | CTCN_663 | 2679 | TTCN_2537 | 8652 |
| CTCN_651 | 2637 | CTCN_2431 | 8610 | ATCN_428 | 2680 | ATCN_1757 | 8653 |
| TTCN_667 | 2638 | GTCN_1353 | 8611 | ATCN_429 | 2681 | TTCN_2538 | 8654 |
| GTCN_350 | 2639 | CTCN_2432 | 8612 | ATCN_430 | 2682 | GTCN_1360 | 8655 |
| CTCN_652 | 2640 | TTCN_2526 | 8613 | ATCN_431 | 2683 | TTCN_2539 | 8656 |
| TTCN_668 | 2641 | TTCN_2527 | 8614 | ATCN_432 | 2684 | TTCN_2540 | 8657 |
| CTCN_653 | 2642 | TTCN_2528 | 8615 | ATCN_433 | 2685 | ATCN_1758 | 8658 |
| TTCN_669 | 2643 | GTCN_1354 | 8616 | CTCN_664 | 2686 | TTCN_2541 | 8659 |
| ATCN_418 | 2644 | ATCN_1749 | 8617 | GTCN_360 | 2687 | ATCN_1759 | 8660 |
| GTCN_351 | 2645 | CTCN_2433 | 8618 | GTCN_361 | 2688 | CTCN_2447 | 8661 |
| ATCN_419 | 2646 | ATCN_1750 | 8619 | CTCN_665 | 2689 | ATCN_1760 | 8662 |
| CTCN_654 | 2647 | CTCN_2434 | 8620 | CTCN_666 | 2690 | CTCN_2448 | 8663 |
| GTCN_352 | 2648 | TTCN_2529 | 8621 | CTCN_667 | 2691 | CTCN_2449 | 8664 |
| ATCN_420 | 2649 | GTCN_1355 | 8622 | CTCN_668 | 2692 | ATCN_1761 | 8665 |
| TTCN_670 | 2650 | TTCN_2530 | 8623 | TTCN_677 | 2693 | ATCN_1762 | 8666 |
| CTCN_655 | 2651 | ATCN_1751 | 8624 | CTCN_669 | 2694 | GTCN_1361 | 8667 |
| ATCN_421 | 2652 | CTCN_2435 | 8625 | CTCN_670 | 2695 | CTCN_2450 | 8668 |
| GTCN_353 | 2653 | CTCN_2436 | 8626 | GTCN_362 | 2696 | TTCN_2542 | 8669 |
| TTCN_671 | 2654 | CTCN_2437 | 8627 | ATCN_434 | 2697 | GTCN_1362 | 8670 |

FIG. 33 (continued)

| | | | | | | | |
|---|---|---|---|---|---|---|---|
| GTCN_363 | 2698 | GTCN_1363 | 8671 | GTCN_377 | 2741 | CTCN_2463 | 8714 |
| GTCN_364 | 2699 | TTCN_2543 | 8672 | TTCN_688 | 2742 | GTCN_1373 | 8715 |
| CTCN_671 | 2700 | GTCN_1364 | 8673 | TTCN_689 | 2743 | TTCN_2558 | 8716 |
| GTCN_365 | 2701 | ATCN_1763 | 8674 | TTCN_690 | 2744 | CTCN_2464 | 8717 |
| ATCN_435 | 2702 | CTCN_2451 | 8675 | ATCN_444 | 2745 | GTCN_1374 | 8718 |
| TTCN_678 | 2703 | CTCN_2452 | 8676 | ATCN_445 | 2746 | CTCN_2465 | 8719 |
| CTCN_672 | 2704 | CTCN_2453 | 8677 | ATCN_446 | 2747 | TTCN_2559 | 8720 |
| GTCN_366 | 2705 | CTCN_2454 | 8678 | ATCN_447 | 2748 | CTCN_2466 | 8721 |
| GTCN_367 | 2706 | TTCN_2544 | 8679 | TTCN_691 | 2749 | ATCN_1769 | 8722 |
| GTCN_368 | 2707 | TTCN_2545 | 8680 | ATCN_448 | 2750 | CTCN_2467 | 8723 |
| CTCN_673 | 2708 | CTCN_2455 | 8681 | ATCN_449 | 2751 | ATCN_1770 | 8724 |
| GTCN_369 | 2709 | CTCN_2456 | 8682 | GTCN_378 | 2752 | GTCN_1375 | 8725 |
| GTCN_370 | 2710 | CTCN_2457 | 8683 | TTCN_692 | 2753 | GTCN_1376 | 8726 |
| ATCN_436 | 2711 | CTCN_2458 | 8684 | CTCN_681 | 2754 | TTCN_2560 | 8727 |
| ATCN_437 | 2712 | CTCN_2459 | 8685 | TTCN_693 | 2755 | CTCN_2468 | 8728 |
| GTCN_371 | 2713 | ATCN_1764 | 8686 | ATCN_450 | 2756 | CTCN_2469 | 8729 |
| TTCN_679 | 2714 | CTCN_2460 | 8687 | CTCN_682 | 2757 | CTCN_2470 | 8730 |
| GTCN_372 | 2715 | GTCN_1365 | 8688 | GTCN_379 | 2758 | TTCN_2561 | 8731 |
| CTCN_674 | 2716 | CTCN_2461 | 8689 | ATCN_451 | 2759 | GTCN_1377 | 8732 |
| GTCN_373 | 2717 | GTCN_1366 | 8690 | TTCN_694 | 2760 | ATCN_1771 | 8733 |
| TTCN_680 | 2718 | GTCN_1367 | 8691 | GTCN_380 | 2761 | ATCN_1772 | 8734 |
| GTCN_374 | 2719 | TTCN_2546 | 8692 | CTCN_683 | 2762 | ATCN_1773 | 8735 |
| ATCN_438 | 2720 | TTCN_2547 | 8693 | ATCN_452 | 2763 | GTCN_1378 | 8736 |
| GTCN_375 | 2721 | TTCN_2548 | 8694 | ATCN_453 | 2764 | CTCN_2471 | 8737 |
| TTCN_681 | 2722 | TTCN_2549 | 8695 | GTCN_381 | 2765 | TTCN_2562 | 8738 |
| ATCN_439 | 2723 | TTCN_2550 | 8696 | TTCN_695 | 2766 | GTCN_1379 | 8739 |
| CTCN_675 | 2724 | TTCN_2551 | 8697 | CTCN_684 | 2767 | TTCN_2563 | 8740 |
| ATCN_440 | 2725 | ATCN_1765 | 8698 | ATCN_454 | 2768 | GTCN_1380 | 8741 |
| TTCN_682 | 2726 | CTCN_2462 | 8699 | GTCN_382 | 2769 | ATCN_1774 | 8742 |
| TTCN_683 | 2727 | TTCN_2552 | 8700 | TTCN_696 | 2770 | ATCN_1775 | 8743 |
| TTCN_684 | 2728 | GTCN_1368 | 8701 | ATCN_455 | 2771 | TTCN_2564 | 8744 |
| TTCN_685 | 2729 | TTCN_2553 | 8702 | ATCN_456 | 2772 | CTCN_2472 | 8745 |
| CTCN_676 | 2730 | TTCN_2554 | 8703 | CTCN_685 | 2773 | TTCN_2565 | 8746 |
| CTCN_677 | 2731 | TTCN_2555 | 8704 | TTCN_697 | 2774 | ATCN_1776 | 8747 |
| TTCN_686 | 2732 | GTCN_1369 | 8705 | TTCN_698 | 2775 | ATCN_1777 | 8748 |
| ATCN_441 | 2733 | ATCN_1766 | 8706 | TTCN_699 | 2776 | ATCN_1778 | 8749 |
| TTCN_687 | 2734 | TTCN_2556 | 8707 | GTCN_383 | 2777 | ATCN_1779 | 8750 |
| CTCN_678 | 2735 | GTCN_1370 | 8708 | TTCN_700 | 2778 | CTCN_2473 | 8751 |
| GTCN_376 | 2736 | TTCN_2557 | 8709 | ATCN_457 | 2779 | CTCN_2474 | 8752 |
| CTCN_679 | 2737 | GTCN_1371 | 8710 | ATCN_458 | 2780 | ATCN_1780 | 8753 |
| ATCN_442 | 2738 | ATCN_1767 | 8711 | TTCN_701 | 2781 | TTCN_2566 | 8754 |
| ATCN_443 | 2739 | ATCN_1768 | 8712 | TTCN_702 | 2782 | ATCN_1781 | 8755 |
| CTCN_680 | 2740 | GTCN_1372 | 8713 | ATCN_459 | 2783 | TTCN_2567 | 8756 |

FIG. 33 (continued)

| | | | | | | | |
|---|---|---|---|---|---|---|---|
| TTCN_703 | 2784 | CTCN_2475 | 8757 | ATCN_473 | 2827 | CTCN_2484 | 8800 |
| TTCN_704 | 2785 | GTCN_1381 | 8758 | ATCN_474 | 2828 | TTCN_2585 | 8801 |
| TTCN_705 | 2786 | TTCN_2568 | 8759 | ATCN_475 | 2829 | CTCN_2485 | 8802 |
| TTCN_706 | 2787 | TTCN_2569 | 8760 | ATCN_476 | 2830 | TTCN_2586 | 8803 |
| CTCN_686 | 2788 | TTCN_2570 | 8761 | TTCN_720 | 2831 | TTCN_2587 | 8804 |
| ATCN_460 | 2789 | GTCN_1382 | 8762 | ATCN_477 | 2832 | GTCN_1388 | 8805 |
| ATCN_461 | 2790 | TTCN_2571 | 8763 | CTCN_693 | 2833 | TTCN_2588 | 8806 |
| ATCN_462 | 2791 | CTCN_2476 | 8764 | TTCN_721 | 2834 | ATCN_1792 | 8807 |
| ATCN_463 | 2792 | GTCN_1383 | 8765 | GTCN_390 | 2835 | ATCN_1793 | 8808 |
| CTCN_687 | 2793 | ATCN_1782 | 8766 | ATCN_478 | 2836 | ATCN_1794 | 8809 |
| CTCN_688 | 2794 | TTCN_2572 | 8767 | TTCN_722 | 2837 | TTCN_2589 | 8810 |
| GTCN_384 | 2795 | ATCN_1783 | 8768 | ATCN_479 | 2838 | GTCN_1389 | 8811 |
| TTCN_707 | 2796 | ATCN_1784 | 8769 | ATCN_480 | 2839 | TTCN_2590 | 8812 |
| TTCN_708 | 2797 | TTCN_2573 | 8770 | ATCN_481 | 2840 | TTCN_2591 | 8813 |
| ATCN_464 | 2798 | CTCN_2477 | 8771 | TTCN_723 | 2841 | TTCN_2592 | 8814 |
| ATCN_465 | 2799 | GTCN_1384 | 8772 | TTCN_724 | 2842 | TTCN_2593 | 8815 |
| CTCN_689 | 2800 | TTCN_2574 | 8773 | TTCN_725 | 2843 | GTCN_1390 | 8816 |
| GTCN_385 | 2801 | TTCN_2575 | 8774 | TTCN_726 | 2844 | GTCN_1391 | 8817 |
| TTCN_709 | 2802 | CTCN_2478 | 8775 | CTCN_694 | 2845 | CTCN_2486 | 8818 |
| CTCN_690 | 2803 | ATCN_1785 | 8776 | CTCN_695 | 2846 | ATCN_1795 | 8819 |
| ATCN_466 | 2804 | TTCN_2576 | 8777 | ATCN_482 | 2847 | CTCN_2487 | 8820 |
| GTCN_386 | 2805 | GTCN_1385 | 8778 | TTCN_727 | 2848 | CTCN_2488 | 8821 |
| ATCN_467 | 2806 | TTCN_2577 | 8779 | CTCN_696 | 2849 | CTCN_2489 | 8822 |
| GTCN_387 | 2807 | CTCN_2479 | 8780 | CTCN_697 | 2850 | CTCN_2490 | 8823 |
| TTCN_710 | 2808 | CTCN_2480 | 8781 | GTCN_391 | 2851 | TTCN_2594 | 8824 |
| TTCN_711 | 2809 | GTCN_1386 | 8782 | ATCN_483 | 2852 | TTCN_2595 | 8825 |
| ATCN_468 | 2810 | ATCN_1786 | 8783 | CTCN_698 | 2853 | TTCN_2596 | 8826 |
| TTCN_712 | 2811 | TTCN_2578 | 8784 | CTCN_699 | 2854 | TTCN_2597 | 8827 |
| TTCN_713 | 2812 | TTCN_2579 | 8785 | CTCN_700 | 2855 | TTCN_2598 | 8828 |
| ATCN_469 | 2813 | CTCN_2481 | 8786 | TTCN_728 | 2856 | TTCN_2599 | 8829 |
| ATCN_470 | 2814 | CTCN_2482 | 8787 | TTCN_729 | 2857 | TTCN_2600 | 8830 |
| ATCN_471 | 2815 | TTCN_2580 | 8788 | CTCN_701 | 2858 | CTCN_2491 | 8831 |
| TTCN_714 | 2816 | TTCN_2581 | 8789 | ATCN_484 | 2859 | CTCN_2492 | 8832 |
| GTCN_388 | 2817 | GTCN_1387 | 8790 | ATCN_485 | 2860 | TTCN_2601 | 8833 |
| TTCN_715 | 2818 | TTCN_2582 | 8791 | ATCN_486 | 2861 | TTCN_2602 | 8834 |
| GTCN_389 | 2819 | TTCN_2583 | 8792 | CTCN_702 | 2862 | TTCN_2603 | 8835 |
| TTCN_716 | 2820 | ATCN_1787 | 8793 | CTCN_703 | 2863 | ATCN_1796 | 8836 |
| TTCN_717 | 2821 | CTCN_2483 | 8794 | ATCN_487 | 2864 | TTCN_2604 | 8837 |
| TTCN_718 | 2822 | ATCN_1788 | 8795 | CTCN_704 | 2865 | GTCN_1392 | 8838 |
| ATCN_472 | 2823 | ATCN_1789 | 8796 | CTCN_705 | 2866 | GTCN_1393 | 8839 |
| CTCN_691 | 2824 | ATCN_1790 | 8797 | ATCN_488 | 2867 | TTCN_2605 | 8840 |
| TTCN_719 | 2825 | TTCN_2584 | 8798 | ATCN_489 | 2868 | ATCN_1797 | 8841 |
| CTCN_692 | 2826 | ATCN_1791 | 8799 | CTCN_706 | 2869 | TTCN_2606 | 8842 |

FIG. 33 (continued)

| | | | | | | | |
|---|---|---|---|---|---|---|---|
| GTCN_392 | 2870 | TTCN_2607 | 8843 | GTCN_397 | 2913 | ATCN_1812 | 8886 |
| CTCN_707 | 2871 | TTCN_2608 | 8844 | CTCN_729 | 2914 | ATCN_1813 | 8887 |
| CTCN_708 | 2872 | ATCN_1798 | 8845 | CTCN_730 | 2915 | TTCN_2621 | 8888 |
| GTCN_393 | 2873 | TTCN_2609 | 8846 | TTCN_738 | 2916 | CTCN_2502 | 8889 |
| GTCN_394 | 2874 | ATCN_1799 | 8847 | TTCN_739 | 2917 | CTCN_2503 | 8890 |
| CTCN_709 | 2875 | ATCN_1800 | 8848 | ATCN_498 | 2918 | GTCN_1400 | 8891 |
| TTCN_730 | 2876 | TTCN_2610 | 8849 | CTCN_731 | 2919 | TTCN_2622 | 8892 |
| ATCN_490 | 2877 | TTCN_2611 | 8850 | TTCN_740 | 2920 | ATCN_1814 | 8893 |
| CTCN_710 | 2878 | ATCN_1801 | 8851 | TTCN_741 | 2921 | CTCN_2504 | 8894 |
| ATCN_491 | 2879 | GTCN_1394 | 8852 | TTCN_742 | 2922 | TTCN_2623 | 8895 |
| CTCN_711 | 2880 | CTCN_2493 | 8853 | TTCN_743 | 2923 | CTCN_2505 | 8896 |
| CTCN_712 | 2881 | ATCN_1802 | 8854 | GTCN_398 | 2924 | ATCN_1815 | 8897 |
| CTCN_713 | 2882 | TTCN_2612 | 8855 | TTCN_744 | 2925 | TTCN_2624 | 8898 |
| TTCN_731 | 2883 | TTCN_2613 | 8856 | CTCN_732 | 2926 | CTCN_2506 | 8899 |
| ATCN_492 | 2884 | GTCN_1395 | 8857 | CTCN_733 | 2927 | CTCN_2507 | 8900 |
| TTCN_732 | 2885 | GTCN_1396 | 8858 | GTCN_399 | 2928 | GTCN_1401 | 8901 |
| CTCN_714 | 2886 | TTCN_2614 | 8859 | TTCN_745 | 2929 | CTCN_2508 | 8902 |
| ATCN_493 | 2887 | TTCN_2615 | 8860 | CTCN_734 | 2930 | GTCN_1402 | 8903 |
| CTCN_715 | 2888 | TTCN_2616 | 8861 | TTCN_746 | 2931 | CTCN_2509 | 8904 |
| CTCN_716 | 2889 | GTCN_1397 | 8862 | CTCN_735 | 2932 | TTCN_2625 | 8905 |
| ATCN_494 | 2890 | CTCN_2494 | 8863 | CTCN_736 | 2933 | TTCN_2626 | 8906 |
| CTCN_717 | 2891 | TTCN_2617 | 8864 | TTCN_747 | 2934 | ATCN_1816 | 8907 |
| GTCN_395 | 2892 | CTCN_2495 | 8865 | ATCN_499 | 2935 | ATCN_1817 | 8908 |
| CTCN_718 | 2893 | TTCN_2618 | 8866 | CTCN_737 | 2936 | TTCN_2627 | 8909 |
| CTCN_719 | 2894 | ATCN_1803 | 8867 | GTCN_400 | 2937 | CTCN_2510 | 8910 |
| GTCN_396 | 2895 | TTCN_2619 | 8868 | TTCN_748 | 2938 | TTCN_2628 | 8911 |
| CTCN_720 | 2896 | ATCN_1804 | 8869 | CTCN_738 | 2939 | ATCN_1818 | 8912 |
| ATCN_495 | 2897 | ATCN_1805 | 8870 | GTCN_401 | 2940 | GTCN_1403 | 8913 |
| CTCN_721 | 2898 | ATCN_1806 | 8871 | ATCN_500 | 2941 | ATCN_1819 | 8914 |
| TTCN_733 | 2899 | ATCN_1807 | 8872 | TTCN_749 | 2942 | ATCN_1820 | 8915 |
| TTCN_734 | 2900 | GTCN_1398 | 8873 | CTCN_739 | 2943 | TTCN_2629 | 8916 |
| TTCN_735 | 2901 | CTCN_2496 | 8874 | TTCN_750 | 2944 | GTCN_1404 | 8917 |
| CTCN_722 | 2902 | ATCN_1808 | 8875 | TTCN_751 | 2945 | TTCN_2630 | 8918 |
| ATCN_496 | 2903 | CTCN_2497 | 8876 | TTCN_752 | 2946 | GTCN_1405 | 8919 |
| ATCN_497 | 2904 | ATCN_1809 | 8877 | CTCN_740 | 2947 | GTCN_1406 | 8920 |
| CTCN_723 | 2905 | ATCN_1810 | 8878 | CTCN_741 | 2948 | TTCN_2631 | 8921 |
| CTCN_724 | 2906 | CTCN_2498 | 8879 | CTCN_742 | 2949 | CTCN_2511 | 8922 |
| TTCN_736 | 2907 | CTCN_2499 | 8880 | TTCN_753 | 2950 | CTCN_2512 | 8923 |
| TTCN_737 | 2908 | ATCN_1811 | 8881 | ATCN_501 | 2951 | TTCN_2632 | 8924 |
| CTCN_725 | 2909 | CTCN_2500 | 8882 | ATCN_502 | 2952 | TTCN_2633 | 8925 |
| CTCN_726 | 2910 | TTCN_2620 | 8883 | TTCN_754 | 2953 | CTCN_2513 | 8926 |
| CTCN_727 | 2911 | GTCN_1399 | 8884 | CTCN_743 | 2954 | GTCN_1407 | 8927 |
| CTCN_728 | 2912 | CTCN_2501 | 8885 | TTCN_755 | 2955 | ATCN_1821 | 8928 |

FIG. 33 (continued)

| | | | | | | | |
|---|---|---|---|---|---|---|---|
| TTCN_756 | 2956 | TTCN_2634 | 8929 | CTCN_755 | 2999 | GTCN_1411 | 8972 |
| ATCN_503 | 2957 | CTCN_2514 | 8930 | TTCN_767 | 3000 | TTCN_2658 | 8973 |
| CTCN_744 | 2958 | TTCN_2635 | 8931 | CTCN_756 | 3001 | CTCN_2523 | 8974 |
| ATCN_504 | 2959 | CTCN_2515 | 8932 | TTCN_768 | 3002 | GTCN_1412 | 8975 |
| ATCN_505 | 2960 | CTCN_2516 | 8933 | GTCN_416 | 3003 | TTCN_2659 | 8976 |
| ATCN_506 | 2961 | TTCN_2636 | 8934 | ATCN_510 | 3004 | TTCN_2660 | 8977 |
| CTCN_745 | 2962 | TTCN_2637 | 8935 | ATCN_511 | 3005 | TTCN_2661 | 8978 |
| TTCN_757 | 2963 | TTCN_2638 | 8936 | GTCN_417 | 3006 | ATCN_1829 | 8979 |
| GTCN_402 | 2964 | TTCN_2639 | 8937 | TTCN_769 | 3007 | TTCN_2662 | 8980 |
| TTCN_758 | 2965 | TTCN_2640 | 8938 | GTCN_418 | 3008 | TTCN_2663 | 8981 |
| TTCN_759 | 2966 | TTCN_2641 | 8939 | TTCN_770 | 3009 | TTCN_2664 | 8982 |
| TTCN_760 | 2967 | ATCN_1822 | 8940 | GTCN_419 | 3010 | TTCN_2665 | 8983 |
| GTCN_403 | 2968 | CTCN_2517 | 8941 | ATCN_512 | 3011 | TTCN_2666 | 8984 |
| CTCN_746 | 2969 | TTCN_2642 | 8942 | CTCN_757 | 3012 | TTCN_2667 | 8985 |
| TTCN_761 | 2970 | TTCN_2643 | 8943 | TTCN_771 | 3013 | TTCN_2668 | 8986 |
| GTCN_404 | 2971 | CTCN_2518 | 8944 | CTCN_758 | 3014 | CTCN_2524 | 8987 |
| CTCN_747 | 2972 | TTCN_2644 | 8945 | TTCN_772 | 3015 | CTCN_2525 | 8988 |
| CTCN_748 | 2973 | ATCN_1823 | 8946 | TTCN_773 | 3016 | ATCN_1830 | 8989 |
| CTCN_749 | 2974 | TTCN_2645 | 8947 | ATCN_513 | 3017 | CTCN_2526 | 8990 |
| TTCN_762 | 2975 | TTCN_2646 | 8948 | GTCN_420 | 3018 | CTCN_2527 | 8991 |
| GTCN_405 | 2976 | ATCN_1824 | 8949 | GTCN_421 | 3019 | ATCN_1831 | 8992 |
| GTCN_406 | 2977 | TTCN_2647 | 8950 | CTCN_759 | 3020 | ATCN_1832 | 8993 |
| GTCN_407 | 2978 | TTCN_2648 | 8951 | ATCN_514 | 3021 | CTCN_2528 | 8994 |
| TTCN_763 | 2979 | TTCN_2649 | 8952 | ATCN_515 | 3022 | GTCN_1413 | 8995 |
| CTCN_750 | 2980 | TTCN_2650 | 8953 | ATCN_516 | 3023 | CTCN_2529 | 8996 |
| CTCN_751 | 2981 | TTCN_2651 | 8954 | CTCN_760 | 3024 | TTCN_2669 | 8997 |
| TTCN_764 | 2982 | GTCN_1408 | 8955 | TTCN_774 | 3025 | CTCN_2530 | 8998 |
| GTCN_408 | 2983 | CTCN_2519 | 8956 | CTCN_761 | 3026 | TTCN_2670 | 8999 |
| ATCN_507 | 2984 | TTCN_2652 | 8957 | ATCN_517 | 3027 | GTCN_1414 | 9000 |
| CTCN_752 | 2985 | CTCN_2520 | 8958 | ATCN_518 | 3028 | ATCN_1833 | 9001 |
| GTCN_409 | 2986 | ATCN_1825 | 8959 | CTCN_762 | 3029 | TTCN_2671 | 9002 |
| CTCN_753 | 2987 | TTCN_2653 | 8960 | TTCN_775 | 3030 | CTCN_2531 | 9003 |
| GTCN_410 | 2988 | TTCN_2654 | 8961 | TTCN_776 | 3031 | GTCN_1415 | 9004 |
| GTCN_411 | 2989 | CTCN_2521 | 8962 | ATCN_519 | 3032 | ATCN_1834 | 9005 |
| TTCN_765 | 2990 | TTCN_2655 | 8963 | TTCN_777 | 3033 | TTCN_2672 | 9006 |
| ATCN_508 | 2991 | GTCN_1409 | 8964 | GTCN_422 | 3034 | ATCN_1835 | 9007 |
| GTCN_412 | 2992 | ATCN_1826 | 8965 | CTCN_763 | 3035 | TTCN_2673 | 9008 |
| ATCN_509 | 2993 | ATCN_1827 | 8966 | ATCN_520 | 3036 | ATCN_1836 | 9009 |
| GTCN_413 | 2994 | TTCN_2656 | 8967 | TTCN_778 | 3037 | CTCN_2532 | 9010 |
| GTCN_414 | 2995 | GTCN_1410 | 8968 | TTCN_779 | 3038 | CTCN_2533 | 9011 |
| GTCN_415 | 2996 | ATCN_1828 | 8969 | TTCN_780 | 3039 | GTCN_1416 | 9012 |
| TTCN_766 | 2997 | TTCN_2657 | 8970 | TTCN_781 | 3040 | TTCN_2674 | 9013 |
| CTCN_754 | 2998 | CTCN_2522 | 8971 | ATCN_521 | 3041 | CTCN_2534 | 9014 |

FIG. 33 (continued)

| | | | | | | | |
|---|---|---|---|---|---|---|---|
| GTCN_423 | 3042 | CTCN_2535 | 9015 | CTCN_782 | 3085 | TTCN_2688 | 9058 |
| TTCN_782 | 3043 | CTCN_2536 | 9016 | GTCN_437 | 3086 | TTCN_2689 | 9059 |
| ATCN_522 | 3044 | TTCN_2675 | 9017 | GTCN_438 | 3087 | TTCN_2690 | 9060 |
| CTCN_764 | 3045 | CTCN_2537 | 9018 | CTCN_783 | 3088 | ATCN_1843 | 9061 |
| GTCN_424 | 3046 | CTCN_2538 | 9019 | GTCN_439 | 3089 | ATCN_1844 | 9062 |
| CTCN_765 | 3047 | GTCN_1417 | 9020 | ATCN_527 | 3090 | ATCN_1845 | 9063 |
| GTCN_425 | 3048 | ATCN_1837 | 9021 | CTCN_784 | 3091 | TTCN_2691 | 9064 |
| CTCN_766 | 3049 | ATCN_1838 | 9022 | TTCN_788 | 3092 | ATCN_1846 | 9065 |
| TTCN_783 | 3050 | CTCN_2539 | 9023 | TTCN_789 | 3093 | TTCN_2692 | 9066 |
| GTCN_426 | 3051 | CTCN_2540 | 9024 | CTCN_785 | 3094 | TTCN_2693 | 9067 |
| GTCN_427 | 3052 | GTCN_1418 | 9025 | TTCN_790 | 3095 | GTCN_1426 | 9068 |
| TTCN_784 | 3053 | CTCN_2541 | 9026 | TTCN_791 | 3096 | ATCN_1847 | 9069 |
| ATCN_523 | 3054 | CTCN_2542 | 9027 | CTCN_786 | 3097 | TTCN_2694 | 9070 |
| GTCN_428 | 3055 | ATCN_1839 | 9028 | TTCN_792 | 3098 | TTCN_2695 | 9071 |
| CTCN_767 | 3056 | CTCN_2543 | 9029 | TTCN_793 | 3099 | TTCN_2696 | 9072 |
| ATCN_524 | 3057 | GTCN_1419 | 9030 | ATCN_528 | 3100 | CTCN_2550 | 9073 |
| CTCN_768 | 3058 | TTCN_2676 | 9031 | GTCN_440 | 3101 | CTCN_2551 | 9074 |
| CTCN_769 | 3059 | CTCN_2544 | 9032 | CTCN_787 | 3102 | TTCN_2697 | 9075 |
| ATCN_525 | 3060 | TTCN_2677 | 9033 | ATCN_529 | 3103 | ATCN_1848 | 9076 |
| ATCN_526 | 3061 | GTCN_1420 | 9034 | TTCN_794 | 3104 | ATCN_1849 | 9077 |
| CTCN_770 | 3062 | GTCN_1421 | 9035 | ATCN_530 | 3105 | TTCN_2698 | 9078 |
| CTCN_771 | 3063 | TTCN_2678 | 9036 | CTCN_788 | 3106 | CTCN_2552 | 9079 |
| CTCN_772 | 3064 | CTCN_2545 | 9037 | ATCN_531 | 3107 | TTCN_2699 | 9080 |
| GTCN_429 | 3065 | TTCN_2679 | 9038 | TTCN_795 | 3108 | ATCN_1850 | 9081 |
| GTCN_430 | 3066 | CTCN_2546 | 9039 | TTCN_796 | 3109 | ATCN_1851 | 9082 |
| CTCN_773 | 3067 | CTCN_2547 | 9040 | CTCN_789 | 3110 | CTCN_2553 | 9083 |
| GTCN_431 | 3068 | TTCN_2680 | 9041 | TTCN_797 | 3111 | ATCN_1852 | 9084 |
| CTCN_774 | 3069 | CTCN_2548 | 9042 | ATCN_532 | 3112 | TTCN_2700 | 9085 |
| GTCN_432 | 3070 | GTCN_1422 | 9043 | CTCN_790 | 3113 | ATCN_1853 | 9086 |
| TTCN_785 | 3071 | GTCN_1423 | 9044 | GTCN_441 | 3114 | GTCN_1427 | 9087 |
| GTCN_433 | 3072 | TTCN_2681 | 9045 | GTCN_442 | 3115 | ATCN_1854 | 9088 |
| CTCN_775 | 3073 | TTCN_2682 | 9046 | ATCN_533 | 3116 | TTCN_2701 | 9089 |
| TTCN_786 | 3074 | ATCN_1840 | 9047 | ATCN_534 | 3117 | CTCN_2554 | 9090 |
| TTCN_787 | 3075 | ATCN_1841 | 9048 | GTCN_443 | 3118 | ATCN_1855 | 9091 |
| GTCN_434 | 3076 | TTCN_2683 | 9049 | ATCN_535 | 3119 | TTCN_2702 | 9092 |
| CTCN_776 | 3077 | ATCN_1842 | 9050 | ATCN_536 | 3120 | GTCN_1428 | 9093 |
| CTCN_777 | 3078 | TTCN_2684 | 9051 | CTCN_791 | 3121 | CTCN_2555 | 9094 |
| CTCN_778 | 3079 | TTCN_2685 | 9052 | ATCN_537 | 3122 | TTCN_2703 | 9095 |
| GTCN_435 | 3080 | TTCN_2686 | 9053 | TTCN_798 | 3123 | CTCN_2556 | 9096 |
| CTCN_779 | 3081 | GTCN_1424 | 9054 | ATCN_538 | 3124 | GTCN_1429 | 9097 |
| CTCN_780 | 3082 | GTCN_1425 | 9055 | GTCN_444 | 3125 | ATCN_1856 | 9098 |
| GTCN_436 | 3083 | TTCN_2687 | 9056 | ATCN_539 | 3126 | CTCN_2557 | 9099 |
| CTCN_781 | 3084 | CTCN_2549 | 9057 | GTCN_445 | 3127 | TTCN_2704 | 9100 |

FIG. 33 (continued)

| | | | | | | | |
|---|---|---|---|---|---|---|---|
| CTCN_792 | 3128 | GTCN_1430 | 9101 | TTCN_807 | 3171 | ATCN_1866 | 9144 |
| ATCN_540 | 3129 | CTCN_2558 | 9102 | GTCN_454 | 3172 | CTCN_2574 | 9145 |
| CTCN_793 | 3130 | ATCN_1857 | 9103 | ATCN_551 | 3173 | ATCN_1867 | 9146 |
| TTCN_799 | 3131 | CTCN_2559 | 9104 | ATCN_552 | 3174 | ATCN_1868 | 9147 |
| ATCN_541 | 3132 | ATCN_1858 | 9105 | GTCN_455 | 3175 | CTCN_2575 | 9148 |
| CTCN_794 | 3133 | TTCN_2705 | 9106 | TTCN_808 | 3176 | TTCN_2718 | 9149 |
| ATCN_542 | 3134 | ATCN_1859 | 9107 | ATCN_553 | 3177 | GTCN_1435 | 9150 |
| TTCN_800 | 3135 | CTCN_2560 | 9108 | TTCN_809 | 3178 | GTCN_1436 | 9151 |
| CTCN_795 | 3136 | TTCN_2706 | 9109 | TTCN_810 | 3179 | ATCN_1869 | 9152 |
| GTCN_446 | 3137 | TTCN_2707 | 9110 | TTCN_811 | 3180 | GTCN_1437 | 9153 |
| CTCN_796 | 3138 | ATCN_1860 | 9111 | CTCN_808 | 3181 | CTCN_2576 | 9154 |
| ATCN_543 | 3139 | CTCN_2561 | 9112 | GTCN_456 | 3182 | ATCN_1870 | 9155 |
| ATCN_544 | 3140 | CTCN_2562 | 9113 | GTCN_457 | 3183 | ATCN_1871 | 9156 |
| CTCN_797 | 3141 | GTCN_1431 | 9114 | ATCN_554 | 3184 | CTCN_2577 | 9157 |
| ATCN_545 | 3142 | CTCN_2563 | 9115 | ATCN_555 | 3185 | TTCN_2719 | 9158 |
| ATCN_546 | 3143 | ATCN_1861 | 9116 | ATCN_556 | 3186 | GTCN_1438 | 9159 |
| CTCN_798 | 3144 | CTCN_2564 | 9117 | ATCN_557 | 3187 | ATCN_1872 | 9160 |
| CTCN_799 | 3145 | TTCN_2708 | 9118 | TTCN_812 | 3188 | CTCN_2578 | 9161 |
| CTCN_800 | 3146 | TTCN_2709 | 9119 | TTCN_813 | 3189 | GTCN_1439 | 9162 |
| CTCN_801 | 3147 | TTCN_2710 | 9120 | ATCN_558 | 3190 | TTCN_2720 | 9163 |
| GTCN_447 | 3148 | ATCN_1862 | 9121 | TTCN_814 | 3191 | CTCN_2579 | 9164 |
| TTCN_801 | 3149 | TTCN_2711 | 9122 | ATCN_559 | 3192 | ATCN_1873 | 9165 |
| CTCN_802 | 3150 | CTCN_2565 | 9123 | TTCN_815 | 3193 | ATCN_1874 | 9166 |
| CTCN_803 | 3151 | TTCN_2712 | 9124 | CTCN_809 | 3194 | TTCN_2721 | 9167 |
| ATCN_547 | 3152 | CTCN_2566 | 9125 | TTCN_816 | 3195 | ATCN_1875 | 9168 |
| ATCN_548 | 3153 | TTCN_2713 | 9126 | TTCN_817 | 3196 | ATCN_1876 | 9169 |
| CTCN_804 | 3154 | TTCN_2714 | 9127 | ATCN_560 | 3197 | ATCN_1877 | 9170 |
| GTCN_448 | 3155 | CTCN_2567 | 9128 | GTCN_458 | 3198 | ATCN_1878 | 9171 |
| CTCN_805 | 3156 | CTCN_2568 | 9129 | CTCN_810 | 3199 | CTCN_2580 | 9172 |
| GTCN_449 | 3157 | GTCN_1432 | 9130 | TTCN_818 | 3200 | GTCN_1440 | 9173 |
| GTCN_450 | 3158 | GTCN_1433 | 9131 | TTCN_819 | 3201 | TTCN_2722 | 9174 |
| ATCN_549 | 3159 | TTCN_2715 | 9132 | ATCN_561 | 3202 | CTCN_2581 | 9175 |
| TTCN_802 | 3160 | CTCN_2569 | 9133 | TTCN_820 | 3203 | TTCN_2723 | 9176 |
| TTCN_803 | 3161 | CTCN_2570 | 9134 | TTCN_821 | 3204 | CTCN_2582 | 9177 |
| GTCN_451 | 3162 | CTCN_2571 | 9135 | ATCN_562 | 3205 | TTCN_2724 | 9178 |
| CTCN_806 | 3163 | TTCN_2716 | 9136 | ATCN_563 | 3206 | GTCN_1441 | 9179 |
| GTCN_452 | 3164 | CTCN_2572 | 9137 | GTCN_459 | 3207 | TTCN_2725 | 9180 |
| TTCN_804 | 3165 | ATCN_1863 | 9138 | GTCN_460 | 3208 | GTCN_1442 | 9181 |
| ATCN_550 | 3166 | ATCN_1864 | 9139 | TTCN_822 | 3209 | ATCN_1879 | 9182 |
| TTCN_805 | 3167 | GTCN_1434 | 9140 | ATCN_564 | 3210 | TTCN_2726 | 9183 |
| CTCN_807 | 3168 | TTCN_2717 | 9141 | GTCN_461 | 3211 | TTCN_2727 | 9184 |
| TTCN_806 | 3169 | CTCN_2573 | 9142 | TTCN_823 | 3212 | ATCN_1880 | 9185 |
| GTCN_453 | 3170 | ATCN_1865 | 9143 | GTCN_462 | 3213 | GTCN_1443 | 9186 |

FIG. 33 (continued)

| | | | | | | | |
|---|---|---|---|---|---|---|---|
| TTCN_824 | 3214 | ATCN_1881 | 9187 | GTCN_469 | 3257 | CTCN_2592 | 9230 |
| ATCN_565 | 3215 | ATCN_1882 | 9188 | CTCN_825 | 3258 | ATCN_1890 | 9231 |
| ATCN_566 | 3216 | GTCN_1444 | 9189 | CTCN_826 | 3259 | TTCN_2748 | 9232 |
| TTCN_825 | 3217 | TTCN_2728 | 9190 | TTCN_839 | 3260 | ATCN_1891 | 9233 |
| TTCN_826 | 3218 | ATCN_1883 | 9191 | CTCN_827 | 3261 | CTCN_2593 | 9234 |
| GTCN_463 | 3219 | GTCN_1445 | 9192 | GTCN_470 | 3262 | ATCN_1892 | 9235 |
| GTCN_464 | 3220 | GTCN_1446 | 9193 | CTCN_828 | 3263 | ATCN_1893 | 9236 |
| TTCN_827 | 3221 | CTCN_2583 | 9194 | CTCN_829 | 3264 | TTCN_2749 | 9237 |
| CTCN_811 | 3222 | TTCN_2729 | 9195 | TTCN_840 | 3265 | GTCN_1449 | 9238 |
| CTCN_812 | 3223 | TTCN_2730 | 9196 | TTCN_841 | 3266 | TTCN_2750 | 9239 |
| CTCN_813 | 3224 | TTCN_2731 | 9197 | TTCN_842 | 3267 | TTCN_2751 | 9240 |
| ATCN_567 | 3225 | TTCN_2732 | 9198 | CTCN_830 | 3268 | TTCN_2752 | 9241 |
| CTCN_814 | 3226 | ATCN_1884 | 9199 | ATCN_573 | 3269 | ATCN_1894 | 9242 |
| CTCN_815 | 3227 | CTCN_2584 | 9200 | CTCN_831 | 3270 | TTCN_2753 | 9243 |
| GTCN_465 | 3228 | TTCN_2733 | 9201 | GTCN_471 | 3271 | GTCN_1450 | 9244 |
| CTCN_816 | 3229 | ATCN_1885 | 9202 | CTCN_832 | 3272 | CTCN_2594 | 9245 |
| CTCN_817 | 3230 | ATCN_1886 | 9203 | GTCN_472 | 3273 | ATCN_1895 | 9246 |
| TTCN_828 | 3231 | CTCN_2585 | 9204 | TTCN_843 | 3274 | ATCN_1896 | 9247 |
| TTCN_829 | 3232 | TTCN_2734 | 9205 | CTCN_833 | 3275 | TTCN_2754 | 9248 |
| TTCN_830 | 3233 | ATCN_1887 | 9206 | CTCN_834 | 3276 | CTCN_2595 | 9249 |
| TTCN_831 | 3234 | TTCN_2735 | 9207 | CTCN_835 | 3277 | TTCN_2755 | 9250 |
| CTCN_818 | 3235 | TTCN_2736 | 9208 | ATCN_574 | 3278 | CTCN_2596 | 9251 |
| ATCN_568 | 3236 | TTCN_2737 | 9209 | ATCN_575 | 3279 | TTCN_2756 | 9252 |
| CTCN_819 | 3237 | TTCN_2738 | 9210 | CTCN_836 | 3280 | ATCN_1897 | 9253 |
| ATCN_569 | 3238 | TTCN_2739 | 9211 | CTCN_837 | 3281 | ATCN_1898 | 9254 |
| TTCN_832 | 3239 | CTCN_2586 | 9212 | CTCN_838 | 3282 | TTCN_2757 | 9255 |
| CTCN_820 | 3240 | CTCN_2587 | 9213 | CTCN_839 | 3283 | TTCN_2758 | 9256 |
| TTCN_833 | 3241 | TTCN_2740 | 9214 | TTCN_844 | 3284 | TTCN_2759 | 9257 |
| TTCN_834 | 3242 | ATCN_1888 | 9215 | TTCN_845 | 3285 | ATCN_1899 | 9258 |
| GTCN_466 | 3243 | CTCN_2588 | 9216 | TTCN_846 | 3286 | ATCN_1900 | 9259 |
| CTCN_821 | 3244 | CTCN_2589 | 9217 | GTCN_473 | 3287 | ATCN_1901 | 9260 |
| ATCN_570 | 3245 | TTCN_2741 | 9218 | TTCN_847 | 3288 | TTCN_2760 | 9261 |
| CTCN_822 | 3246 | CTCN_2590 | 9219 | ATCN_576 | 3289 | ATCN_1902 | 9262 |
| TTCN_835 | 3247 | TTCN_2742 | 9220 | GTCN_474 | 3290 | TTCN_2761 | 9263 |
| TTCN_836 | 3248 | TTCN_2743 | 9221 | TTCN_848 | 3291 | TTCN_2762 | 9264 |
| TTCN_837 | 3249 | GTCN_1447 | 9222 | GTCN_475 | 3292 | ATCN_1903 | 9265 |
| TTCN_838 | 3250 | ATCN_1889 | 9223 | TTCN_849 | 3293 | ATCN_1904 | 9266 |
| ATCN_571 | 3251 | GTCN_1448 | 9224 | GTCN_476 | 3294 | ATCN_1905 | 9267 |
| ATCN_572 | 3252 | CTCN_2591 | 9225 | CTCN_840 | 3295 | ATCN_1906 | 9268 |
| CTCN_823 | 3253 | TTCN_2744 | 9226 | CTCN_841 | 3296 | CTCN_2597 | 9269 |
| GTCN_467 | 3254 | TTCN_2745 | 9227 | TTCN_850 | 3297 | TTCN_2763 | 9270 |
| CTCN_824 | 3255 | TTCN_2746 | 9228 | TTCN_851 | 3298 | ATCN_1907 | 9271 |
| GTCN_468 | 3256 | TTCN_2747 | 9229 | TTCN_852 | 3299 | ATCN_1908 | 9272 |

FIG. 33 (continued)

| | | | | | | | |
|---|---|---|---|---|---|---|---|
| ATCN_577 | 3300 | TTCN_2764 | 9273 | TTCN_867 | 3343 | TTCN_2782 | 9316 |
| ATCN_578 | 3301 | TTCN_2765 | 9274 | ATCN_590 | 3344 | GTCN_1457 | 9317 |
| TTCN_853 | 3302 | CTCN_2598 | 9275 | ATCN_591 | 3345 | GTCN_1458 | 9318 |
| TTCN_854 | 3303 | TTCN_2766 | 9276 | ATCN_592 | 3346 | TTCN_2783 | 9319 |
| TTCN_855 | 3304 | TTCN_2767 | 9277 | TTCN_868 | 3347 | ATCN_1917 | 9320 |
| CTCN_842 | 3305 | CTCN_2599 | 9278 | TTCN_869 | 3348 | TTCN_2784 | 9321 |
| GTCN_477 | 3306 | TTCN_2768 | 9279 | CTCN_847 | 3349 | GTCN_1459 | 9322 |
| GTCN_478 | 3307 | CTCN_2600 | 9280 | GTCN_488 | 3350 | TTCN_2785 | 9323 |
| GTCN_479 | 3308 | TTCN_2769 | 9281 | CTCN_848 | 3351 | CTCN_2609 | 9324 |
| TTCN_856 | 3309 | TTCN_2770 | 9282 | ATCN_593 | 3352 | TTCN_2786 | 9325 |
| ATCN_579 | 3310 | TTCN_2771 | 9283 | ATCN_594 | 3353 | TTCN_2787 | 9326 |
| TTCN_857 | 3311 | GTCN_1451 | 9284 | TTCN_870 | 3354 | TTCN_2788 | 9327 |
| ATCN_580 | 3312 | TTCN_2772 | 9285 | CTCN_849 | 3355 | TTCN_2789 | 9328 |
| GTCN_480 | 3313 | ATCN_1909 | 9286 | ATCN_595 | 3356 | GTCN_1460 | 9329 |
| ATCN_581 | 3314 | CTCN_2601 | 9287 | CTCN_850 | 3357 | TTCN_2790 | 9330 |
| ATCN_582 | 3315 | TTCN_2773 | 9288 | GTCN_489 | 3358 | CTCN_2610 | 9331 |
| TTCN_858 | 3316 | CTCN_2602 | 9289 | TTCN_871 | 3359 | CTCN_2611 | 9332 |
| ATCN_583 | 3317 | CTCN_2603 | 9290 | GTCN_490 | 3360 | TTCN_2791 | 9333 |
| TTCN_859 | 3318 | CTCN_2604 | 9291 | ATCN_596 | 3361 | TTCN_2792 | 9334 |
| TTCN_860 | 3319 | CTCN_2605 | 9292 | TTCN_872 | 3362 | ATCN_1918 | 9335 |
| GTCN_481 | 3320 | CTCN_2606 | 9293 | CTCN_851 | 3363 | TTCN_2793 | 9336 |
| ATCN_584 | 3321 | GTCN_1452 | 9294 | CTCN_852 | 3364 | TTCN_2794 | 9337 |
| TTCN_861 | 3322 | GTCN_1453 | 9295 | GTCN_491 | 3365 | ATCN_1919 | 9338 |
| ATCN_585 | 3323 | ATCN_1910 | 9296 | TTCN_873 | 3366 | GTCN_1461 | 9339 |
| CTCN_843 | 3324 | CTCN_2607 | 9297 | ATCN_597 | 3367 | ATCN_1920 | 9340 |
| TTCN_862 | 3325 | TTCN_2774 | 9298 | TTCN_874 | 3368 | CTCN_2612 | 9341 |
| GTCN_482 | 3326 | ATCN_1911 | 9299 | TTCN_875 | 3369 | ATCN_1921 | 9342 |
| TTCN_863 | 3327 | TTCN_2775 | 9300 | CTCN_853 | 3370 | ATCN_1922 | 9343 |
| TTCN_864 | 3328 | TTCN_2776 | 9301 | TTCN_876 | 3371 | TTCN_2795 | 9344 |
| ATCN_586 | 3329 | TTCN_2777 | 9302 | ATCN_598 | 3372 | ATCN_1923 | 9345 |
| GTCN_483 | 3330 | CTCN_2608 | 9303 | TTCN_877 | 3373 | GTCN_1462 | 9346 |
| TTCN_865 | 3331 | ATCN_1912 | 9304 | GTCN_492 | 3374 | ATCN_1924 | 9347 |
| GTCN_484 | 3332 | ATCN_1913 | 9305 | ATCN_599 | 3375 | TTCN_2796 | 9348 |
| CTCN_844 | 3333 | GTCN_1454 | 9306 | ATCN_600 | 3376 | TTCN_2797 | 9349 |
| GTCN_485 | 3334 | ATCN_1914 | 9307 | ATCN_601 | 3377 | ATCN_1925 | 9350 |
| CTCN_845 | 3335 | ATCN_1915 | 9308 | TTCN_878 | 3378 | ATCN_1926 | 9351 |
| GTCN_486 | 3336 | TTCN_2778 | 9309 | GTCN_493 | 3379 | ATCN_1927 | 9352 |
| ATCN_587 | 3337 | TTCN_2779 | 9310 | ATCN_602 | 3380 | ATCN_1928 | 9353 |
| ATCN_588 | 3338 | GTCN_1455 | 9311 | TTCN_879 | 3381 | TTCN_2798 | 9354 |
| TTCN_866 | 3339 | TTCN_2780 | 9312 | GTCN_494 | 3382 | ATCN_1929 | 9355 |
| GTCN_487 | 3340 | GTCN_1456 | 9313 | ATCN_603 | 3383 | TTCN_2799 | 9356 |
| ATCN_589 | 3341 | ATCN_1916 | 9314 | ATCN_604 | 3384 | ATCN_1930 | 9357 |
| CTCN_846 | 3342 | TTCN_2781 | 9315 | ATCN_605 | 3385 | TTCN_2800 | 9358 |

FIG. 33 (continued)

| | | | | | | | |
|---|---|---|---|---|---|---|---|
| GTCN_495 | 3386 | ATCN_1931 | 9359 | CTCN_861 | 3429 | TTCN_2818 | 9402 |
| TTCN_880 | 3387 | CTCN_2613 | 9360 | CTCN_862 | 3430 | TTCN_2819 | 9403 |
| ATCN_606 | 3388 | CTCN_2614 | 9361 | ATCN_616 | 3431 | TTCN_2820 | 9404 |
| ATCN_607 | 3389 | GTCN_1463 | 9362 | GTCN_499 | 3432 | TTCN_2821 | 9405 |
| TTCN_881 | 3390 | ATCN_1932 | 9363 | GTCN_500 | 3433 | ATCN_1943 | 9406 |
| GTCN_496 | 3391 | ATCN_1933 | 9364 | TTCN_902 | 3434 | CTCN_2625 | 9407 |
| TTCN_882 | 3392 | CTCN_2615 | 9365 | ATCN_617 | 3435 | GTCN_1465 | 9408 |
| ATCN_608 | 3393 | TTCN_2801 | 9366 | TTCN_903 | 3436 | CTCN_2626 | 9409 |
| TTCN_883 | 3394 | ATCN_1934 | 9367 | GTCN_501 | 3437 | ATCN_1944 | 9410 |
| TTCN_884 | 3395 | TTCN_2802 | 9368 | TTCN_904 | 3438 | TTCN_2822 | 9411 |
| TTCN_885 | 3396 | TTCN_2803 | 9369 | TTCN_905 | 3439 | CTCN_2627 | 9412 |
| CTCN_854 | 3397 | CTCN_2616 | 9370 | TTCN_906 | 3440 | ATCN_1945 | 9413 |
| ATCN_609 | 3398 | ATCN_1935 | 9371 | GTCN_502 | 3441 | GTCN_1466 | 9414 |
| TTCN_886 | 3399 | CTCN_2617 | 9372 | CTCN_863 | 3442 | CTCN_2628 | 9415 |
| TTCN_887 | 3400 | TTCN_2804 | 9373 | GTCN_503 | 3443 | GTCN_1467 | 9416 |
| TTCN_888 | 3401 | ATCN_1936 | 9374 | TTCN_907 | 3444 | CTCN_2629 | 9417 |
| TTCN_889 | 3402 | TTCN_2805 | 9375 | GTCN_504 | 3445 | TTCN_2823 | 9418 |
| CTCN_855 | 3403 | TTCN_2806 | 9376 | GTCN_505 | 3446 | GTCN_1468 | 9419 |
| TTCN_890 | 3404 | TTCN_2807 | 9377 | CTCN_864 | 3447 | TTCN_2824 | 9420 |
| TTCN_891 | 3405 | ATCN_1937 | 9378 | CTCN_865 | 3448 | ATCN_1946 | 9421 |
| CTCN_856 | 3406 | TTCN_2808 | 9379 | TTCN_908 | 3449 | ATCN_1947 | 9422 |
| TTCN_892 | 3407 | TTCN_2809 | 9380 | CTCN_866 | 3450 | TTCN_2825 | 9423 |
| GTCN_497 | 3408 | TTCN_2810 | 9381 | CTCN_867 | 3451 | TTCN_2826 | 9424 |
| TTCN_893 | 3409 | TTCN_2811 | 9382 | CTCN_868 | 3452 | TTCN_2827 | 9425 |
| TTCN_894 | 3410 | TTCN_2812 | 9383 | TTCN_909 | 3453 | ATCN_1948 | 9426 |
| ATCN_610 | 3411 | CTCN_2618 | 9384 | CTCN_869 | 3454 | TTCN_2828 | 9427 |
| TTCN_895 | 3412 | ATCN_1938 | 9385 | GTCN_506 | 3455 | ATCN_1949 | 9428 |
| TTCN_896 | 3413 | TTCN_2813 | 9386 | TTCN_910 | 3456 | ATCN_1950 | 9429 |
| TTCN_897 | 3414 | ATCN_1939 | 9387 | GTCN_507 | 3457 | GTCN_1469 | 9430 |
| CTCN_857 | 3415 | ATCN_1940 | 9388 | TTCN_911 | 3458 | ATCN_1951 | 9431 |
| TTCN_898 | 3416 | TTCN_2814 | 9389 | CTCN_870 | 3459 | TTCN_2829 | 9432 |
| ATCN_611 | 3417 | CTCN_2619 | 9390 | GTCN_508 | 3460 | TTCN_2830 | 9433 |
| GTCN_498 | 3418 | TTCN_2815 | 9391 | CTCN_871 | 3461 | TTCN_2831 | 9434 |
| CTCN_858 | 3419 | ATCN_1941 | 9392 | ATCN_618 | 3462 | ATCN_1952 | 9435 |
| ATCN_612 | 3420 | CTCN_2620 | 9393 | ATCN_619 | 3463 | TTCN_2832 | 9436 |
| TTCN_899 | 3421 | TTCN_2816 | 9394 | CTCN_872 | 3464 | GTCN_1470 | 9437 |
| TTCN_900 | 3422 | CTCN_2621 | 9395 | CTCN_873 | 3465 | GTCN_1471 | 9438 |
| CTCN_859 | 3423 | CTCN_2622 | 9396 | GTCN_509 | 3466 | ATCN_1953 | 9439 |
| TTCN_901 | 3424 | ATCN_1942 | 9397 | TTCN_912 | 3467 | ATCN_1954 | 9440 |
| ATCN_613 | 3425 | CTCN_2623 | 9398 | CTCN_874 | 3468 | GTCN_1472 | 9441 |
| ATCN_614 | 3426 | CTCN_2624 | 9399 | TTCN_913 | 3469 | CTCN_2630 | 9442 |
| CTCN_860 | 3427 | TTCN_2817 | 9400 | ATCN_620 | 3470 | TTCN_2833 | 9443 |
| ATCN_615 | 3428 | GTCN_1464 | 9401 | TTCN_914 | 3471 | TTCN_2834 | 9444 |

FIG. 33 (continued)

| | | | | | | | |
|---|---|---|---|---|---|---|---|
| CTCN_875 | 3472 | TTCN_2835 | 9445 | GTCN_515 | 3515 | TTCN_2852 | 9488 |
| ATCN_621 | 3473 | GTCN_1473 | 9446 | TTCN_930 | 3516 | GTCN_1479 | 9489 |
| TTCN_915 | 3474 | TTCN_2836 | 9447 | TTCN_931 | 3517 | TTCN_2853 | 9490 |
| GTCN_510 | 3475 | CTCN_2631 | 9448 | CTCN_886 | 3518 | TTCN_2854 | 9491 |
| CTCN_876 | 3476 | GTCN_1474 | 9449 | TTCN_932 | 3519 | TTCN_2855 | 9492 |
| GTCN_511 | 3477 | CTCN_2632 | 9450 | ATCN_633 | 3520 | CTCN_2647 | 9493 |
| TTCN_916 | 3478 | GTCN_1475 | 9451 | TTCN_933 | 3521 | GTCN_1480 | 9494 |
| TTCN_917 | 3479 | TTCN_2837 | 9452 | CTCN_887 | 3522 | ATCN_1959 | 9495 |
| ATCN_622 | 3480 | CTCN_2633 | 9453 | TTCN_934 | 3523 | TTCN_2856 | 9496 |
| ATCN_623 | 3481 | ATCN_1955 | 9454 | TTCN_935 | 3524 | ATCN_1960 | 9497 |
| TTCN_918 | 3482 | CTCN_2634 | 9455 | CTCN_888 | 3525 | TTCN_2857 | 9498 |
| TTCN_919 | 3483 | GTCN_1476 | 9456 | CTCN_889 | 3526 | ATCN_1961 | 9499 |
| CTCN_877 | 3484 | CTCN_2635 | 9457 | ATCN_634 | 3527 | TTCN_2858 | 9500 |
| CTCN_878 | 3485 | CTCN_2636 | 9458 | CTCN_890 | 3528 | ATCN_1962 | 9501 |
| CTCN_879 | 3486 | CTCN_2637 | 9459 | GTCN_516 | 3529 | GTCN_1481 | 9502 |
| CTCN_880 | 3487 | TTCN_2838 | 9460 | CTCN_891 | 3530 | ATCN_1963 | 9503 |
| CTCN_881 | 3488 | TTCN_2839 | 9461 | TTCN_936 | 3531 | TTCN_2859 | 9504 |
| CTCN_882 | 3489 | TTCN_2840 | 9462 | CTCN_892 | 3532 | CTCN_2648 | 9505 |
| CTCN_883 | 3490 | CTCN_2638 | 9463 | TTCN_937 | 3533 | TTCN_2860 | 9506 |
| TTCN_920 | 3491 | CTCN_2639 | 9464 | TTCN_938 | 3534 | ATCN_1964 | 9507 |
| ATCN_624 | 3492 | CTCN_2640 | 9465 | TTCN_939 | 3535 | ATCN_1965 | 9508 |
| ATCN_625 | 3493 | TTCN_2841 | 9466 | CTCN_893 | 3536 | ATCN_1966 | 9509 |
| ATCN_626 | 3494 | CTCN_2641 | 9467 | GTCN_517 | 3537 | TTCN_2861 | 9510 |
| TTCN_921 | 3495 | CTCN_2642 | 9468 | ATCN_635 | 3538 | ATCN_1967 | 9511 |
| CTCN_884 | 3496 | ATCN_1956 | 9469 | ATCN_636 | 3539 | GTCN_1482 | 9512 |
| ATCN_627 | 3497 | ATCN_1957 | 9470 | CTCN_894 | 3540 | CTCN_2649 | 9513 |
| TTCN_922 | 3498 | GTCN_1477 | 9471 | CTCN_895 | 3541 | GTCN_1483 | 9514 |
| ATCN_628 | 3499 | TTCN_2842 | 9472 | GTCN_518 | 3542 | GTCN_1484 | 9515 |
| ATCN_629 | 3500 | TTCN_2843 | 9473 | CTCN_896 | 3543 | CTCN_2650 | 9516 |
| ATCN_630 | 3501 | TTCN_2844 | 9474 | CTCN_897 | 3544 | GTCN_1485 | 9517 |
| TTCN_923 | 3502 | GTCN_1478 | 9475 | ATCN_637 | 3545 | ATCN_1968 | 9518 |
| TTCN_924 | 3503 | CTCN_2643 | 9476 | ATCN_638 | 3546 | TTCN_2862 | 9519 |
| TTCN_925 | 3504 | TTCN_2845 | 9477 | CTCN_898 | 3547 | TTCN_2863 | 9520 |
| ATCN_631 | 3505 | TTCN_2846 | 9478 | CTCN_899 | 3548 | ATCN_1969 | 9521 |
| GTCN_512 | 3506 | TTCN_2847 | 9479 | CTCN_900 | 3549 | ATCN_1970 | 9522 |
| TTCN_926 | 3507 | CTCN_2644 | 9480 | CTCN_901 | 3550 | ATCN_1971 | 9523 |
| GTCN_513 | 3508 | TTCN_2848 | 9481 | TTCN_940 | 3551 | ATCN_1972 | 9524 |
| ATCN_632 | 3509 | TTCN_2849 | 9482 | GTCN_519 | 3552 | TTCN_2864 | 9525 |
| GTCN_514 | 3510 | CTCN_2645 | 9483 | CTCN_902 | 3553 | TTCN_2865 | 9526 |
| CTCN_885 | 3511 | CTCN_2646 | 9484 | CTCN_903 | 3554 | TTCN_2866 | 9527 |
| TTCN_927 | 3512 | TTCN_2850 | 9485 | CTCN_904 | 3555 | GTCN_1486 | 9528 |
| TTCN_928 | 3513 | ATCN_1958 | 9486 | CTCN_905 | 3556 | GTCN_1487 | 9529 |
| TTCN_929 | 3514 | TTCN_2851 | 9487 | CTCN_906 | 3557 | ATCN_1973 | 9530 |

FIG. 33 (continued)

| | | | | | | | |
|---|---|---|---|---|---|---|---|
| ATCN_639 | 3558 | TTCN_2867 | 9531 | CTCN_913 | 3601 | ATCN_1981 | 9574 |
| CTCN_907 | 3559 | GTCN_1488 | 9532 | TTCN_952 | 3602 | TTCN_2892 | 9575 |
| ATCN_640 | 3560 | TTCN_2868 | 9533 | GTCN_532 | 3603 | CTCN_2659 | 9576 |
| GTCN_520 | 3561 | TTCN_2869 | 9534 | CTCN_914 | 3604 | ATCN_1982 | 9577 |
| TTCN_941 | 3562 | TTCN_2870 | 9535 | CTCN_915 | 3605 | ATCN_1983 | 9578 |
| CTCN_908 | 3563 | ATCN_1974 | 9536 | TTCN_953 | 3606 | CTCN_2660 | 9579 |
| CTCN_909 | 3564 | TTCN_2871 | 9537 | GTCN_533 | 3607 | TTCN_2893 | 9580 |
| ATCN_641 | 3565 | TTCN_2872 | 9538 | GTCN_534 | 3608 | ATCN_1984 | 9581 |
| CTCN_910 | 3566 | TTCN_2873 | 9539 | GTCN_535 | 3609 | ATCN_1985 | 9582 |
| TTCN_942 | 3567 | GTCN_1489 | 9540 | ATCN_653 | 3610 | CTCN_2661 | 9583 |
| TTCN_943 | 3568 | TTCN_2874 | 9541 | GTCN_536 | 3611 | CTCN_2662 | 9584 |
| GTCN_521 | 3569 | CTCN_2651 | 9542 | CTCN_916 | 3612 | ATCN_1986 | 9585 |
| TTCN_944 | 3570 | GTCN_1490 | 9543 | ATCN_654 | 3613 | CTCN_2663 | 9586 |
| GTCN_522 | 3571 | TTCN_2875 | 9544 | CTCN_917 | 3614 | TTCN_2894 | 9587 |
| TTCN_945 | 3572 | TTCN_2876 | 9545 | ATCN_655 | 3615 | ATCN_1987 | 9588 |
| ATCN_642 | 3573 | CTCN_2652 | 9546 | CTCN_918 | 3616 | TTCN_2895 | 9589 |
| TTCN_946 | 3574 | ATCN_1975 | 9547 | ATCN_656 | 3617 | CTCN_2664 | 9590 |
| TTCN_947 | 3575 | CTCN_2653 | 9548 | CTCN_919 | 3618 | GTCN_1491 | 9591 |
| ATCN_643 | 3576 | CTCN_2654 | 9549 | CTCN_920 | 3619 | TTCN_2896 | 9592 |
| GTCN_523 | 3577 | CTCN_2655 | 9550 | TTCN_954 | 3620 | TTCN_2897 | 9593 |
| ATCN_644 | 3578 | ATCN_1976 | 9551 | TTCN_955 | 3621 | TTCN_2898 | 9594 |
| ATCN_645 | 3579 | ATCN_1977 | 9552 | GTCN_537 | 3622 | TTCN_2899 | 9595 |
| TTCN_948 | 3580 | TTCN_2877 | 9553 | CTCN_921 | 3623 | CTCN_2665 | 9596 |
| GTCN_524 | 3581 | TTCN_2878 | 9554 | ATCN_657 | 3624 | CTCN_2666 | 9597 |
| ATCN_646 | 3582 | TTCN_2879 | 9555 | GTCN_538 | 3625 | ATCN_1988 | 9598 |
| GTCN_525 | 3583 | TTCN_2880 | 9556 | CTCN_922 | 3626 | GTCN_1492 | 9599 |
| ATCN_647 | 3584 | TTCN_2881 | 9557 | CTCN_923 | 3627 | CTCN_2667 | 9600 |
| TTCN_949 | 3585 | CTCN_2656 | 9558 | GTCN_539 | 3628 | TTCN_2900 | 9601 |
| GTCN_526 | 3586 | TTCN_2882 | 9559 | CTCN_924 | 3629 | CTCN_2668 | 9602 |
| TTCN_950 | 3587 | TTCN_2883 | 9560 | GTCN_540 | 3630 | TTCN_2901 | 9603 |
| GTCN_527 | 3588 | TTCN_2884 | 9561 | CTCN_925 | 3631 | TTCN_2902 | 9604 |
| ATCN_648 | 3589 | TTCN_2885 | 9562 | GTCN_541 | 3632 | ATCN_1989 | 9605 |
| ATCN_649 | 3590 | CTCN_2657 | 9563 | CTCN_926 | 3633 | GTCN_1493 | 9606 |
| GTCN_528 | 3591 | TTCN_2886 | 9564 | ATCN_658 | 3634 | ATCN_1990 | 9607 |
| GTCN_529 | 3592 | ATCN_1978 | 9565 | CTCN_927 | 3635 | TTCN_2903 | 9608 |
| GTCN_530 | 3593 | ATCN_1979 | 9566 | CTCN_928 | 3636 | CTCN_2669 | 9609 |
| ATCN_650 | 3594 | ATCN_1980 | 9567 | CTCN_929 | 3637 | CTCN_2670 | 9610 |
| CTCN_911 | 3595 | TTCN_2887 | 9568 | TTCN_956 | 3638 | CTCN_2671 | 9611 |
| TTCN_951 | 3596 | TTCN_2888 | 9569 | TTCN_957 | 3639 | TTCN_2904 | 9612 |
| ATCN_651 | 3597 | CTCN_2658 | 9570 | CTCN_930 | 3640 | GTCN_1494 | 9613 |
| ATCN_652 | 3598 | TTCN_2889 | 9571 | CTCN_931 | 3641 | CTCN_2672 | 9614 |
| GTCN_531 | 3599 | TTCN_2890 | 9572 | CTCN_932 | 3642 | GTCN_1495 | 9615 |
| CTCN_912 | 3600 | TTCN_2891 | 9573 | CTCN_933 | 3643 | TTCN_2905 | 9616 |

FIG. 33 (continued)

| | | | | | | | |
|---|---|---|---|---|---|---|---|
| GTCN_542 | 3644 | ATCN_1991 | 9617 | ATCN_665 | 3687 | GTCN_1502 | 9660 |
| CTCN_934 | 3645 | TTCN_2906 | 9618 | CTCN_956 | 3688 | GTCN_1503 | 9661 |
| CTCN_935 | 3646 | CTCN_2673 | 9619 | ATCN_666 | 3689 | GTCN_1504 | 9662 |
| GTCN_543 | 3647 | TTCN_2907 | 9620 | GTCN_549 | 3690 | TTCN_2917 | 9663 |
| TTCN_958 | 3648 | CTCN_2674 | 9621 | GTCN_550 | 3691 | ATCN_2001 | 9664 |
| ATCN_659 | 3649 | CTCN_2675 | 9622 | TTCN_966 | 3692 | ATCN_2002 | 9665 |
| GTCN_544 | 3650 | GTCN_1496 | 9623 | TTCN_967 | 3693 | GTCN_1505 | 9666 |
| CTCN_936 | 3651 | CTCN_2676 | 9624 | GTCN_551 | 3694 | CTCN_2689 | 9667 |
| ATCN_660 | 3652 | ATCN_1992 | 9625 | CTCN_957 | 3695 | GTCN_1506 | 9668 |
| ATCN_661 | 3653 | TTCN_2908 | 9626 | ATCN_667 | 3696 | TTCN_2918 | 9669 |
| CTCN_937 | 3654 | CTCN_2677 | 9627 | TTCN_968 | 3697 | ATCN_2003 | 9670 |
| GTCN_545 | 3655 | TTCN_2909 | 9628 | ATCN_668 | 3698 | TTCN_2919 | 9671 |
| CTCN_938 | 3656 | TTCN_2910 | 9629 | TTCN_969 | 3699 | TTCN_2920 | 9672 |
| ATCN_662 | 3657 | GTCN_1497 | 9630 | TTCN_970 | 3700 | CTCN_2690 | 9673 |
| ATCN_663 | 3658 | CTCN_2678 | 9631 | CTCN_958 | 3701 | ATCN_2004 | 9674 |
| CTCN_939 | 3659 | GTCN_1498 | 9632 | TTCN_971 | 3702 | ATCN_2005 | 9675 |
| CTCN_940 | 3660 | ATCN_1993 | 9633 | GTCN_552 | 3703 | TTCN_2921 | 9676 |
| ATCN_664 | 3661 | GTCN_1499 | 9634 | GTCN_553 | 3704 | CTCN_2691 | 9677 |
| CTCN_941 | 3662 | CTCN_2679 | 9635 | TTCN_972 | 3705 | TTCN_2922 | 9678 |
| CTCN_942 | 3663 | GTCN_1500 | 9636 | ATCN_669 | 3706 | ATCN_2006 | 9679 |
| TTCN_959 | 3664 | CTCN_2680 | 9637 | CTCN_959 | 3707 | TTCN_2923 | 9680 |
| CTCN_943 | 3665 | CTCN_2681 | 9638 | CTCN_960 | 3708 | TTCN_2924 | 9681 |
| TTCN_960 | 3666 | CTCN_2682 | 9639 | GTCN_554 | 3709 | TTCN_2925 | 9682 |
| TTCN_961 | 3667 | TTCN_2911 | 9640 | TTCN_973 | 3710 | ATCN_2007 | 9683 |
| TTCN_962 | 3668 | ATCN_1994 | 9641 | TTCN_974 | 3711 | CTCN_2692 | 9684 |
| TTCN_963 | 3669 | CTCN_2683 | 9642 | TTCN_975 | 3712 | TTCN_2926 | 9685 |
| CTCN_944 | 3670 | CTCN_2684 | 9643 | TTCN_976 | 3713 | CTCN_2693 | 9686 |
| CTCN_945 | 3671 | ATCN_1995 | 9644 | TTCN_977 | 3714 | TTCN_2927 | 9687 |
| CTCN_946 | 3672 | ATCN_1996 | 9645 | GTCN_555 | 3715 | TTCN_2928 | 9688 |
| GTCN_546 | 3673 | GTCN_1501 | 9646 | TTCN_978 | 3716 | TTCN_2929 | 9689 |
| CTCN_947 | 3674 | TTCN_2912 | 9647 | CTCN_961 | 3717 | CTCN_2694 | 9690 |
| CTCN_948 | 3675 | CTCN_2685 | 9648 | CTCN_962 | 3718 | GTCN_1507 | 9691 |
| CTCN_949 | 3676 | TTCN_2913 | 9649 | ATCN_670 | 3719 | CTCN_2695 | 9692 |
| CTCN_950 | 3677 | ATCN_1997 | 9650 | TTCN_979 | 3720 | CTCN_2696 | 9693 |
| TTCN_964 | 3678 | TTCN_2914 | 9651 | CTCN_963 | 3721 | CTCN_2697 | 9694 |
| CTCN_951 | 3679 | ATCN_1998 | 9652 | ATCN_671 | 3722 | TTCN_2930 | 9695 |
| GTCN_547 | 3680 | CTCN_2686 | 9653 | CTCN_964 | 3723 | ATCN_2008 | 9696 |
| CTCN_952 | 3681 | ATCN_1999 | 9654 | ATCN_672 | 3724 | TTCN_2931 | 9697 |
| TTCN_965 | 3682 | TTCN_2915 | 9655 | ATCN_673 | 3725 | CTCN_2698 | 9698 |
| CTCN_953 | 3683 | TTCN_2916 | 9656 | ATCN_674 | 3726 | GTCN_1508 | 9699 |
| CTCN_954 | 3684 | CTCN_2687 | 9657 | GTCN_556 | 3727 | CTCN_2699 | 9700 |
| CTCN_955 | 3685 | ATCN_2000 | 9658 | TTCN_980 | 3728 | TTCN_2932 | 9701 |
| GTCN_548 | 3686 | CTCN_2688 | 9659 | TTCN_981 | 3729 | TTCN_2933 | 9702 |

FIG. 33 (continued)

| | | | | | | | |
|---|---|---|---|---|---|---|---|
| CTCN_965 | 3730 | TTCN_2934 | 9703 | CTCN_984 | 3773 | CTCN_2707 | 9746 |
| CTCN_966 | 3731 | ATCN_2009 | 9704 | TTCN_993 | 3774 | ATCN_2020 | 9747 |
| CTCN_967 | 3732 | ATCN_2010 | 9705 | CTCN_985 | 3775 | CTCN_2708 | 9748 |
| GTCN_557 | 3733 | TTCN_2935 | 9706 | GTCN_564 | 3776 | TTCN_2952 | 9749 |
| TTCN_982 | 3734 | ATCN_2011 | 9707 | TTCN_994 | 3777 | TTCN_2953 | 9750 |
| GTCN_558 | 3735 | GTCN_1509 | 9708 | CTCN_986 | 3778 | ATCN_2021 | 9751 |
| CTCN_968 | 3736 | TTCN_2936 | 9709 | ATCN_681 | 3779 | ATCN_2022 | 9752 |
| CTCN_969 | 3737 | TTCN_2937 | 9710 | CTCN_987 | 3780 | GTCN_1516 | 9753 |
| TTCN_983 | 3738 | TTCN_2938 | 9711 | GTCN_565 | 3781 | TTCN_2954 | 9754 |
| GTCN_559 | 3739 | ATCN_2012 | 9712 | CTCN_988 | 3782 | TTCN_2955 | 9755 |
| GTCN_560 | 3740 | GTCN_1510 | 9713 | CTCN_989 | 3783 | TTCN_2956 | 9756 |
| CTCN_970 | 3741 | TTCN_2939 | 9714 | GTCN_566 | 3784 | GTCN_1517 | 9757 |
| ATCN_675 | 3742 | TTCN_2940 | 9715 | CTCN_990 | 3785 | ATCN_2023 | 9758 |
| ATCN_676 | 3743 | GTCN_1511 | 9716 | CTCN_991 | 3786 | TTCN_2957 | 9759 |
| TTCN_984 | 3744 | CTCN_2700 | 9717 | TTCN_995 | 3787 | CTCN_2709 | 9760 |
| CTCN_971 | 3745 | CTCN_2701 | 9718 | ATCN_682 | 3788 | ATCN_2024 | 9761 |
| TTCN_985 | 3746 | TTCN_2941 | 9719 | TTCN_996 | 3789 | TTCN_2958 | 9762 |
| TTCN_986 | 3747 | ATCN_2013 | 9720 | CTCN_992 | 3790 | GTCN_1518 | 9763 |
| CTCN_972 | 3748 | ATCN_2014 | 9721 | CTCN_993 | 3791 | ATCN_2025 | 9764 |
| CTCN_973 | 3749 | TTCN_2942 | 9722 | ATCN_683 | 3792 | TTCN_2959 | 9765 |
| ATCN_677 | 3750 | TTCN_2943 | 9723 | CTCN_994 | 3793 | ATCN_2026 | 9766 |
| TTCN_987 | 3751 | TTCN_2944 | 9724 | GTCN_567 | 3794 | CTCN_2710 | 9767 |
| TTCN_988 | 3752 | CTCN_2702 | 9725 | GTCN_568 | 3795 | CTCN_2711 | 9768 |
| CTCN_974 | 3753 | TTCN_2945 | 9726 | CTCN_995 | 3796 | TTCN_2960 | 9769 |
| CTCN_975 | 3754 | TTCN_2946 | 9727 | GTCN_569 | 3797 | TTCN_2961 | 9770 |
| CTCN_976 | 3755 | CTCN_2703 | 9728 | CTCN_996 | 3798 | TTCN_2962 | 9771 |
| GTCN_561 | 3756 | CTCN_2704 | 9729 | GTCN_570 | 3799 | GTCN_1519 | 9772 |
| CTCN_977 | 3757 | CTCN_2705 | 9730 | CTCN_997 | 3800 | TTCN_2963 | 9773 |
| GTCN_562 | 3758 | GTCN_1512 | 9731 | GTCN_571 | 3801 | TTCN_2964 | 9774 |
| ATCN_678 | 3759 | GTCN_1513 | 9732 | ATCN_684 | 3802 | ATCN_2027 | 9775 |
| ATCN_679 | 3760 | TTCN_2947 | 9733 | TTCN_997 | 3803 | ATCN_2028 | 9776 |
| CTCN_978 | 3761 | ATCN_2015 | 9734 | TTCN_998 | 3804 | TTCN_2965 | 9777 |
| TTCN_989 | 3762 | ATCN_2016 | 9735 | CTCN_998 | 3805 | CTCN_2712 | 9778 |
| TTCN_990 | 3763 | TTCN_2948 | 9736 | ATCN_685 | 3806 | CTCN_2713 | 9779 |
| TTCN_991 | 3764 | GTCN_1514 | 9737 | TTCN_999 | 3807 | TTCN_2966 | 9780 |
| TTCN_992 | 3765 | ATCN_2017 | 9738 | TTCN_1000 | 3808 | TTCN_2967 | 9781 |
| CTCN_979 | 3766 | ATCN_2018 | 9739 | CTCN_999 | 3809 | CTCN_2714 | 9782 |
| ATCN_680 | 3767 | ATCN_2019 | 9740 | GTCN_572 | 3810 | GTCN_1520 | 9783 |
| CTCN_980 | 3768 | TTCN_2949 | 9741 | GTCN_573 | 3811 | CTCN_2715 | 9784 |
| CTCN_981 | 3769 | TTCN_2950 | 9742 | CTCN_1000 | 3812 | ATCN_2029 | 9785 |
| CTCN_982 | 3770 | TTCN_2951 | 9743 | CTCN_1001 | 3813 | ATCN_2030 | 9786 |
| GTCN_563 | 3771 | GTCN_1515 | 9744 | GTCN_574 | 3814 | CTCN_2716 | 9787 |
| CTCN_983 | 3772 | CTCN_2706 | 9745 | ATCN_686 | 3815 | GTCN_1521 | 9788 |

FIG. 33 (continued)

| | | | | | | | |
|---|---|---|---|---|---|---|---|
| CTCN_1002 | 3816 | ATCN_2031 | 9789 | ATCN_694 | 3859 | ATCN_2042 | 9832 |
| CTCN_1003 | 3817 | ATCN_2032 | 9790 | TTCN_1012 | 3860 | GTCN_1525 | 9833 |
| CTCN_1004 | 3818 | TTCN_2968 | 9791 | ATCN_695 | 3861 | CTCN_2726 | 9834 |
| TTCN_1001 | 3819 | TTCN_2969 | 9792 | CTCN_1023 | 3862 | GTCN_1526 | 9835 |
| TTCN_1002 | 3820 | TTCN_2970 | 9793 | ATCN_696 | 3863 | CTCN_2727 | 9836 |
| CTCN_1005 | 3821 | TTCN_2971 | 9794 | GTCN_579 | 3864 | GTCN_1527 | 9837 |
| ATCN_687 | 3822 | ATCN_2033 | 9795 | CTCN_1024 | 3865 | CTCN_2728 | 9838 |
| TTCN_1003 | 3823 | GTCN_1522 | 9796 | CTCN_1025 | 3866 | TTCN_2988 | 9839 |
| CTCN_1006 | 3824 | CTCN_2717 | 9797 | CTCN_1026 | 3867 | TTCN_2989 | 9840 |
| CTCN_1007 | 3825 | TTCN_2972 | 9798 | TTCN_1013 | 3868 | TTCN_2990 | 9841 |
| GTCN_575 | 3826 | TTCN_2973 | 9799 | ATCN_697 | 3869 | CTCN_2729 | 9842 |
| CTCN_1008 | 3827 | TTCN_2974 | 9800 | CTCN_1027 | 3870 | TTCN_2991 | 9843 |
| TTCN_1004 | 3828 | CTCN_2718 | 9801 | CTCN_1028 | 3871 | CTCN_2730 | 9844 |
| ATCN_688 | 3829 | TTCN_2975 | 9802 | CTCN_1029 | 3872 | GTCN_1528 | 9845 |
| CTCN_1009 | 3830 | TTCN_2976 | 9803 | CTCN_1030 | 3873 | TTCN_2992 | 9846 |
| GTCN_576 | 3831 | TTCN_2977 | 9804 | ATCN_698 | 3874 | ATCN_2043 | 9847 |
| TTCN_1005 | 3832 | TTCN_2978 | 9805 | ATCN_699 | 3875 | TTCN_2993 | 9848 |
| GTCN_577 | 3833 | GTCN_1523 | 9806 | CTCN_1031 | 3876 | CTCN_2731 | 9849 |
| CTCN_1010 | 3834 | TTCN_2979 | 9807 | GTCN_580 | 3877 | GTCN_1529 | 9850 |
| CTCN_1011 | 3835 | TTCN_2980 | 9808 | CTCN_1032 | 3878 | ATCN_2044 | 9851 |
| GTCN_578 | 3836 | TTCN_2981 | 9809 | CTCN_1033 | 3879 | CTCN_2732 | 9852 |
| CTCN_1012 | 3837 | TTCN_2982 | 9810 | GTCN_581 | 3880 | ATCN_2045 | 9853 |
| ATCN_689 | 3838 | CTCN_2719 | 9811 | GTCN_582 | 3881 | ATCN_2046 | 9854 |
| ATCN_690 | 3839 | GTCN_1524 | 9812 | CTCN_1034 | 3882 | ATCN_2047 | 9855 |
| CTCN_1013 | 3840 | CTCN_2720 | 9813 | CTCN_1035 | 3883 | TTCN_2994 | 9856 |
| CTCN_1014 | 3841 | TTCN_2983 | 9814 | ATCN_700 | 3884 | GTCN_1530 | 9857 |
| CTCN_1015 | 3842 | CTCN_2721 | 9815 | TTCN_1014 | 3885 | ATCN_2048 | 9858 |
| ATCN_691 | 3843 | TTCN_2984 | 9816 | CTCN_1036 | 3886 | TTCN_2995 | 9859 |
| CTCN_1016 | 3844 | ATCN_2034 | 9817 | ATCN_701 | 3887 | ATCN_2049 | 9860 |
| TTCN_1006 | 3845 | ATCN_2035 | 9818 | ATCN_702 | 3888 | TTCN_2996 | 9861 |
| CTCN_1017 | 3846 | ATCN_2036 | 9819 | GTCN_583 | 3889 | TTCN_2997 | 9862 |
| TTCN_1007 | 3847 | ATCN_2037 | 9820 | CTCN_1037 | 3890 | TTCN_2998 | 9863 |
| TTCN_1008 | 3848 | ATCN_2038 | 9821 | TTCN_1015 | 3891 | CTCN_2733 | 9864 |
| TTCN_1009 | 3849 | ATCN_2039 | 9822 | GTCN_584 | 3892 | TTCN_2999 | 9865 |
| TTCN_1010 | 3850 | TTCN_2985 | 9823 | TTCN_1016 | 3893 | TTCN_3000 | 9866 |
| TTCN_1011 | 3851 | ATCN_2040 | 9824 | ATCN_703 | 3894 | CTCN_2734 | 9867 |
| CTCN_1018 | 3852 | TTCN_2986 | 9825 | CTCN_1038 | 3895 | TTCN_3001 | 9868 |
| ATCN_692 | 3853 | TTCN_2987 | 9826 | ATCN_704 | 3896 | TTCN_3002 | 9869 |
| CTCN_1019 | 3854 | CTCN_2722 | 9827 | GTCN_585 | 3897 | ATCN_2050 | 9870 |
| CTCN_1020 | 3855 | CTCN_2723 | 9828 | TTCN_1017 | 3898 | CTCN_2735 | 9871 |
| CTCN_1021 | 3856 | CTCN_2724 | 9829 | ATCN_705 | 3899 | CTCN_2736 | 9872 |
| CTCN_1022 | 3857 | ATCN_2041 | 9830 | CTCN_1039 | 3900 | CTCN_2737 | 9873 |
| ATCN_693 | 3858 | CTCN_2725 | 9831 | CTCN_1040 | 3901 | TTCN_3003 | 9874 |

FIG. 33 (continued)

| | | | | | | | |
|---|---|---|---|---|---|---|---|
| TTCN_1018 | 3902 | CTCN_2738 | 9875 | ATCN_713 | 3945 | CTCN_2746 | 9918 |
| TTCN_1019 | 3903 | GTCN_1531 | 9876 | CTCN_1057 | 3946 | GTCN_1538 | 9919 |
| CTCN_1041 | 3904 | GTCN_1532 | 9877 | CTCN_1058 | 3947 | ATCN_2061 | 9920 |
| CTCN_1042 | 3905 | TTCN_3004 | 9878 | CTCN_1059 | 3948 | ATCN_2062 | 9921 |
| CTCN_1043 | 3906 | GTCN_1533 | 9879 | CTCN_1060 | 3949 | ATCN_2063 | 9922 |
| ATCN_706 | 3907 | ATCN_2051 | 9880 | CTCN_1061 | 3950 | ATCN_2064 | 9923 |
| CTCN_1044 | 3908 | TTCN_3005 | 9881 | CTCN_1062 | 3951 | ATCN_2065 | 9924 |
| CTCN_1045 | 3909 | ATCN_2052 | 9882 | CTCN_1063 | 3952 | ATCN_2066 | 9925 |
| TTCN_1020 | 3910 | ATCN_2053 | 9883 | GTCN_590 | 3953 | TTCN_3022 | 9926 |
| CTCN_1046 | 3911 | TTCN_3006 | 9884 | TTCN_1034 | 3954 | TTCN_3023 | 9927 |
| GTCN_586 | 3912 | TTCN_3007 | 9885 | CTCN_1064 | 3955 | CTCN_2747 | 9928 |
| TTCN_1021 | 3913 | CTCN_2739 | 9886 | CTCN_1065 | 3956 | GTCN_1539 | 9929 |
| TTCN_1022 | 3914 | CTCN_2740 | 9887 | TTCN_1035 | 3957 | GTCN_1540 | 9930 |
| ATCN_707 | 3915 | TTCN_3008 | 9888 | ATCN_714 | 3958 | TTCN_3024 | 9931 |
| TTCN_1023 | 3916 | ATCN_2054 | 9889 | TTCN_1036 | 3959 | TTCN_3025 | 9932 |
| CTCN_1047 | 3917 | ATCN_2055 | 9890 | TTCN_1037 | 3960 | TTCN_3026 | 9933 |
| TTCN_1024 | 3918 | CTCN_2741 | 9891 | TTCN_1038 | 3961 | TTCN_3027 | 9934 |
| ATCN_708 | 3919 | ATCN_2056 | 9892 | ATCN_715 | 3962 | TTCN_3028 | 9935 |
| CTCN_1048 | 3920 | CTCN_2742 | 9893 | ATCN_716 | 3963 | GTCN_1541 | 9936 |
| TTCN_1025 | 3921 | TTCN_3009 | 9894 | CTCN_1066 | 3964 | CTCN_2748 | 9937 |
| TTCN_1026 | 3922 | TTCN_3010 | 9895 | CTCN_1067 | 3965 | ATCN_2067 | 9938 |
| CTCN_1049 | 3923 | CTCN_2743 | 9896 | GTCN_591 | 3966 | TTCN_3029 | 9939 |
| TTCN_1027 | 3924 | TTCN_3011 | 9897 | ATCN_717 | 3967 | GTCN_1542 | 9940 |
| CTCN_1050 | 3925 | TTCN_3012 | 9898 | CTCN_1068 | 3968 | CTCN_2749 | 9941 |
| CTCN_1051 | 3926 | ATCN_2057 | 9899 | TTCN_1039 | 3969 | TTCN_3030 | 9942 |
| GTCN_587 | 3927 | GTCN_1534 | 9900 | ATCN_718 | 3970 | CTCN_2750 | 9943 |
| ATCN_709 | 3928 | TTCN_3013 | 9901 | TTCN_1040 | 3971 | ATCN_2068 | 9944 |
| ATCN_710 | 3929 | CTCN_2744 | 9902 | ATCN_719 | 3972 | TTCN_3031 | 9945 |
| TTCN_1028 | 3930 | TTCN_3014 | 9903 | ATCN_720 | 3973 | TTCN_3032 | 9946 |
| TTCN_1029 | 3931 | TTCN_3015 | 9904 | TTCN_1041 | 3974 | ATCN_2069 | 9947 |
| CTCN_1052 | 3932 | ATCN_2058 | 9905 | TTCN_1042 | 3975 | ATCN_2070 | 9948 |
| TTCN_1030 | 3933 | TTCN_3016 | 9906 | ATCN_721 | 3976 | GTCN_1543 | 9949 |
| TTCN_1031 | 3934 | TTCN_3017 | 9907 | CTCN_1069 | 3977 | GTCN_1544 | 9950 |
| TTCN_1032 | 3935 | TTCN_3018 | 9908 | CTCN_1070 | 3978 | CTCN_2751 | 9951 |
| ATCN_711 | 3936 | ATCN_2059 | 9909 | TTCN_1043 | 3979 | CTCN_2752 | 9952 |
| CTCN_1053 | 3937 | TTCN_3019 | 9910 | CTCN_1071 | 3980 | CTCN_2753 | 9953 |
| TTCN_1033 | 3938 | CTCN_2745 | 9911 | TTCN_1044 | 3981 | CTCN_2754 | 9954 |
| GTCN_588 | 3939 | ATCN_2060 | 9912 | CTCN_1072 | 3982 | ATCN_2071 | 9955 |
| GTCN_589 | 3940 | GTCN_1535 | 9913 | TTCN_1045 | 3983 | CTCN_2755 | 9956 |
| CTCN_1054 | 3941 | TTCN_3020 | 9914 | GTCN_592 | 3984 | GTCN_1545 | 9957 |
| CTCN_1055 | 3942 | GTCN_1536 | 9915 | TTCN_1046 | 3985 | GTCN_1546 | 9958 |
| CTCN_1056 | 3943 | TTCN_3021 | 9916 | TTCN_1047 | 3986 | CTCN_2756 | 9959 |
| ATCN_712 | 3944 | GTCN_1537 | 9917 | ATCN_722 | 3987 | TTCN_3033 | 9960 |

FIG. 33 (continued)

| | | | | | | | |
|---|---|---|---|---|---|---|---|
| ATCN_723 | 3988 | ATCN_2072 | 9961 | GTCN_600 | 4031 | TTCN_3049 | 10004 |
| TTCN_1048 | 3989 | CTCN_2757 | 9962 | CTCN_1095 | 4032 | ATCN_2080 | 10005 |
| CTCN_1073 | 3990 | CTCN_2758 | 9963 | ATCN_732 | 4033 | TTCN_3050 | 10006 |
| CTCN_1074 | 3991 | CTCN_2759 | 9964 | ATCN_733 | 4034 | TTCN_3051 | 10007 |
| GTCN_593 | 3992 | TTCN_3034 | 9965 | ATCN_734 | 4035 | GTCN_1555 | 10008 |
| ATCN_724 | 3993 | ATCN_2073 | 9966 | GTCN_601 | 4036 | ATCN_2081 | 10009 |
| CTCN_1075 | 3994 | ATCN_2074 | 9967 | ATCN_735 | 4037 | CTCN_2769 | 10010 |
| CTCN_1076 | 3995 | ATCN_2075 | 9968 | CTCN_1096 | 4038 | CTCN_2770 | 10011 |
| CTCN_1077 | 3996 | GTCN_1547 | 9969 | TTCN_1053 | 4039 | GTCN_1556 | 10012 |
| ATCN_725 | 3997 | CTCN_2760 | 9970 | TTCN_1054 | 4040 | TTCN_3052 | 10013 |
| ATCN_726 | 3998 | GTCN_1548 | 9971 | GTCN_602 | 4041 | GTCN_1557 | 10014 |
| CTCN_1078 | 3999 | TTCN_3035 | 9972 | GTCN_603 | 4042 | TTCN_3053 | 10015 |
| GTCN_594 | 4000 | CTCN_2761 | 9973 | CTCN_1097 | 4043 | GTCN_1558 | 10016 |
| CTCN_1079 | 4001 | TTCN_3036 | 9974 | CTCN_1098 | 4044 | GTCN_1559 | 10017 |
| ATCN_727 | 4002 | TTCN_3037 | 9975 | TTCN_1055 | 4045 | GTCN_1560 | 10018 |
| ATCN_728 | 4003 | GTCN_1549 | 9976 | GTCN_604 | 4046 | TTCN_3054 | 10019 |
| TTCN_1049 | 4004 | TTCN_3038 | 9977 | TTCN_1056 | 4047 | CTCN_2771 | 10020 |
| ATCN_729 | 4005 | TTCN_3039 | 9978 | TTCN_1057 | 4048 | GTCN_1561 | 10021 |
| TTCN_1050 | 4006 | TTCN_3040 | 9979 | TTCN_1058 | 4049 | ATCN_2082 | 10022 |
| GTCN_595 | 4007 | ATCN_2076 | 9980 | CTCN_1099 | 4050 | CTCN_2772 | 10023 |
| CTCN_1080 | 4008 | ATCN_2077 | 9981 | TTCN_1059 | 4051 | TTCN_3055 | 10024 |
| CTCN_1081 | 4009 | TTCN_3041 | 9982 | GTCN_605 | 4052 | TTCN_3056 | 10025 |
| CTCN_1082 | 4010 | GTCN_1550 | 9983 | ATCN_736 | 4053 | ATCN_2083 | 10026 |
| CTCN_1083 | 4011 | CTCN_2762 | 9984 | GTCN_606 | 4054 | TTCN_3057 | 10027 |
| GTCN_596 | 4012 | GTCN_1551 | 9985 | TTCN_1060 | 4055 | ATCN_2084 | 10028 |
| CTCN_1084 | 4013 | CTCN_2763 | 9986 | TTCN_1061 | 4056 | ATCN_2085 | 10029 |
| CTCN_1085 | 4014 | GTCN_1552 | 9987 | TTCN_1062 | 4057 | ATCN_2086 | 10030 |
| CTCN_1086 | 4015 | TTCN_3042 | 9988 | CTCN_1100 | 4058 | CTCN_2773 | 10031 |
| CTCN_1087 | 4016 | CTCN_2764 | 9989 | CTCN_1101 | 4059 | CTCN_2774 | 10032 |
| TTCN_1051 | 4017 | CTCN_2765 | 9990 | GTCN_607 | 4060 | TTCN_3058 | 10033 |
| TTCN_1052 | 4018 | TTCN_3043 | 9991 | TTCN_1063 | 4061 | TTCN_3059 | 10034 |
| CTCN_1088 | 4019 | ATCN_2078 | 9992 | CTCN_1102 | 4062 | ATCN_2087 | 10035 |
| CTCN_1089 | 4020 | TTCN_3044 | 9993 | GTCN_608 | 4063 | TTCN_3060 | 10036 |
| GTCN_597 | 4021 | TTCN_3045 | 9994 | GTCN_609 | 4064 | TTCN_3061 | 10037 |
| CTCN_1090 | 4022 | GTCN_1553 | 9995 | GTCN_610 | 4065 | CTCN_2775 | 10038 |
| ATCN_730 | 4023 | CTCN_2766 | 9996 | GTCN_611 | 4066 | ATCN_2088 | 10039 |
| ATCN_731 | 4024 | TTCN_3046 | 9997 | GTCN_612 | 4067 | ATCN_2089 | 10040 |
| CTCN_1091 | 4025 | TTCN_3047 | 9998 | GTCN_613 | 4068 | TTCN_3062 | 10041 |
| GTCN_598 | 4026 | ATCN_2079 | 9999 | ATCN_737 | 4069 | TTCN_3063 | 10042 |
| CTCN_1092 | 4027 | CTCN_2767 | 10000 | ATCN_738 | 4070 | ATCN_2090 | 10043 |
| CTCN_1093 | 4028 | CTCN_2768 | 10001 | TTCN_1064 | 4071 | GTCN_1562 | 10044 |
| GTCN_599 | 4029 | GTCN_1554 | 10002 | TTCN_1065 | 4072 | CTCN_2776 | 10045 |
| CTCN_1094 | 4030 | TTCN_3048 | 10003 | TTCN_1066 | 4073 | GTCN_1563 | 10046 |

FIG. 33 (continued)

| | | | | | | | |
|---|---|---|---|---|---|---|---|
| CTCN_1103 | 4074 | TTCN_3064 | 10047 | ATCN_750 | 4117 | TTCN_3077 | 10090 |
| TTCN_1067 | 4075 | CTCN_2777 | 10048 | ATCN_751 | 4118 | CTCN_2788 | 10091 |
| ATCN_739 | 4076 | ATCN_2091 | 10049 | TTCN_1080 | 4119 | TTCN_3078 | 10092 |
| TTCN_1068 | 4077 | ATCN_2092 | 10050 | ATCN_752 | 4120 | TTCN_3079 | 10093 |
| ATCN_740 | 4078 | TTCN_3065 | 10051 | CTCN_1117 | 4121 | ATCN_2104 | 10094 |
| ATCN_741 | 4079 | TTCN_3066 | 10052 | GTCN_619 | 4122 | TTCN_3080 | 10095 |
| TTCN_1069 | 4080 | CTCN_2778 | 10053 | CTCN_1118 | 4123 | GTCN_1570 | 10096 |
| CTCN_1104 | 4081 | CTCN_2779 | 10054 | CTCN_1119 | 4124 | ATCN_2105 | 10097 |
| CTCN_1105 | 4082 | ATCN_2093 | 10055 | GTCN_620 | 4125 | TTCN_3081 | 10098 |
| TTCN_1070 | 4083 | ATCN_2094 | 10056 | CTCN_1120 | 4126 | TTCN_3082 | 10099 |
| TTCN_1071 | 4084 | ATCN_2095 | 10057 | ATCN_753 | 4127 | CTCN_2789 | 10100 |
| CTCN_1106 | 4085 | CTCN_2780 | 10058 | ATCN_754 | 4128 | CTCN_2790 | 10101 |
| ATCN_742 | 4086 | CTCN_2781 | 10059 | ATCN_755 | 4129 | TTCN_3083 | 10102 |
| CTCN_1107 | 4087 | CTCN_2782 | 10060 | CTCN_1121 | 4130 | TTCN_3084 | 10103 |
| TTCN_1072 | 4088 | TTCN_3067 | 10061 | CTCN_1122 | 4131 | ATCN_2106 | 10104 |
| CTCN_1108 | 4089 | ATCN_2096 | 10062 | CTCN_1123 | 4132 | TTCN_3085 | 10105 |
| ATCN_743 | 4090 | TTCN_3068 | 10063 | GTCN_621 | 4133 | ATCN_2107 | 10106 |
| CTCN_1109 | 4091 | CTCN_2783 | 10064 | CTCN_1124 | 4134 | TTCN_3086 | 10107 |
| TTCN_1073 | 4092 | CTCN_2784 | 10065 | TTCN_1081 | 4135 | CTCN_2791 | 10108 |
| TTCN_1074 | 4093 | TTCN_3069 | 10066 | TTCN_1082 | 4136 | TTCN_3087 | 10109 |
| TTCN_1075 | 4094 | ATCN_2097 | 10067 | TTCN_1083 | 4137 | ATCN_2108 | 10110 |
| ATCN_744 | 4095 | TTCN_3070 | 10068 | CTCN_1125 | 4138 | CTCN_2792 | 10111 |
| CTCN_1110 | 4096 | ATCN_2098 | 10069 | TTCN_1084 | 4139 | TTCN_3088 | 10112 |
| TTCN_1076 | 4097 | ATCN_2099 | 10070 | CTCN_1126 | 4140 | TTCN_3089 | 10113 |
| TTCN_1077 | 4098 | ATCN_2100 | 10071 | GTCN_622 | 4141 | TTCN_3090 | 10114 |
| GTCN_614 | 4099 | TTCN_3071 | 10072 | CTCN_1127 | 4142 | GTCN_1571 | 10115 |
| TTCN_1078 | 4100 | ATCN_2101 | 10073 | GTCN_623 | 4143 | CTCN_2793 | 10116 |
| ATCN_745 | 4101 | CTCN_2785 | 10074 | TTCN_1085 | 4144 | CTCN_2794 | 10117 |
| ATCN_746 | 4102 | GTCN_1564 | 10075 | GTCN_624 | 4145 | CTCN_2795 | 10118 |
| GTCN_615 | 4103 | GTCN_1565 | 10076 | CTCN_1128 | 4146 | GTCN_1572 | 10119 |
| CTCN_1111 | 4104 | GTCN_1566 | 10077 | TTCN_1086 | 4147 | ATCN_2109 | 10120 |
| GTCN_616 | 4105 | GTCN_1567 | 10078 | CTCN_1129 | 4148 | ATCN_2110 | 10121 |
| CTCN_1112 | 4106 | TTCN_3072 | 10079 | CTCN_1130 | 4149 | ATCN_2111 | 10122 |
| CTCN_1113 | 4107 | TTCN_3073 | 10080 | ATCN_756 | 4150 | ATCN_2112 | 10123 |
| GTCN_617 | 4108 | TTCN_3074 | 10081 | ATCN_757 | 4151 | GTCN_1573 | 10124 |
| ATCN_747 | 4109 | TTCN_3075 | 10082 | CTCN_1131 | 4152 | CTCN_2796 | 10125 |
| ATCN_748 | 4110 | CTCN_2786 | 10083 | GTCN_625 | 4153 | TTCN_3091 | 10126 |
| CTCN_1114 | 4111 | GTCN_1568 | 10084 | TTCN_1087 | 4154 | TTCN_3092 | 10127 |
| ATCN_749 | 4112 | TTCN_3076 | 10085 | ATCN_758 | 4155 | ATCN_2113 | 10128 |
| GTCN_618 | 4113 | ATCN_2102 | 10086 | CTCN_1132 | 4156 | GTCN_1574 | 10129 |
| CTCN_1115 | 4114 | CTCN_2787 | 10087 | GTCN_626 | 4157 | CTCN_2797 | 10130 |
| TTCN_1079 | 4115 | ATCN_2103 | 10088 | ATCN_759 | 4158 | TTCN_3093 | 10131 |
| CTCN_1116 | 4116 | GTCN_1569 | 10089 | CTCN_1133 | 4159 | ATCN_2114 | 10132 |

FIG. 33 (continued)

| | | | | | | | |
|---|---|---|---|---|---|---|---|
| GTCN_627 | 4160 | TTCN_3094 | 10133 | TTCN_1095 | 4203 | ATCN_2127 | 10176 |
| GTCN_628 | 4161 | ATCN_2115 | 10134 | GTCN_635 | 4204 | TTCN_3115 | 10177 |
| CTCN_1134 | 4162 | CTCN_2798 | 10135 | CTCN_1155 | 4205 | TTCN_3116 | 10178 |
| CTCN_1135 | 4163 | TTCN_3095 | 10136 | TTCN_1096 | 4206 | TTCN_3117 | 10179 |
| GTCN_629 | 4164 | TTCN_3096 | 10137 | CTCN_1156 | 4207 | GTCN_1580 | 10180 |
| CTCN_1136 | 4165 | CTCN_2799 | 10138 | CTCN_1157 | 4208 | GTCN_1581 | 10181 |
| ATCN_760 | 4166 | ATCN_2116 | 10139 | ATCN_767 | 4209 | TTCN_3118 | 10182 |
| ATCN_761 | 4167 | ATCN_2117 | 10140 | TTCN_1097 | 4210 | ATCN_2128 | 10183 |
| CTCN_1137 | 4168 | TTCN_3097 | 10141 | TTCN_1098 | 4211 | TTCN_3119 | 10184 |
| CTCN_1138 | 4169 | ATCN_2118 | 10142 | ATCN_768 | 4212 | CTCN_2803 | 10185 |
| CTCN_1139 | 4170 | TTCN_3098 | 10143 | TTCN_1099 | 4213 | GTCN_1582 | 10186 |
| TTCN_1088 | 4171 | TTCN_3099 | 10144 | TTCN_1100 | 4214 | TTCN_3120 | 10187 |
| TTCN_1089 | 4172 | TTCN_3100 | 10145 | CTCN_1158 | 4215 | GTCN_1583 | 10188 |
| TTCN_1090 | 4173 | TTCN_3101 | 10146 | TTCN_1101 | 4216 | TTCN_3121 | 10189 |
| CTCN_1140 | 4174 | ATCN_2119 | 10147 | CTCN_1159 | 4217 | TTCN_3122 | 10190 |
| CTCN_1141 | 4175 | ATCN_2120 | 10148 | GTCN_636 | 4218 | TTCN_3123 | 10191 |
| CTCN_1142 | 4176 | ATCN_2121 | 10149 | TTCN_1102 | 4219 | CTCN_2804 | 10192 |
| ATCN_762 | 4177 | TTCN_3102 | 10150 | GTCN_637 | 4220 | TTCN_3124 | 10193 |
| CTCN_1143 | 4178 | GTCN_1575 | 10151 | TTCN_1103 | 4221 | TTCN_3125 | 10194 |
| GTCN_630 | 4179 | TTCN_3103 | 10152 | CTCN_1160 | 4222 | GTCN_1584 | 10195 |
| CTCN_1144 | 4180 | GTCN_1576 | 10153 | CTCN_1161 | 4223 | CTCN_2805 | 10196 |
| GTCN_631 | 4181 | TTCN_3104 | 10154 | ATCN_769 | 4224 | TTCN_3126 | 10197 |
| CTCN_1145 | 4182 | GTCN_1577 | 10155 | ATCN_770 | 4225 | TTCN_3127 | 10198 |
| CTCN_1146 | 4183 | TTCN_3105 | 10156 | TTCN_1104 | 4226 | TTCN_3128 | 10199 |
| ATCN_763 | 4184 | ATCN_2122 | 10157 | TTCN_1105 | 4227 | TTCN_3129 | 10200 |
| ATCN_764 | 4185 | TTCN_3106 | 10158 | GTCN_638 | 4228 | TTCN_3130 | 10201 |
| CTCN_1147 | 4186 | ATCN_2123 | 10159 | GTCN_639 | 4229 | TTCN_3131 | 10202 |
| TTCN_1091 | 4187 | CTCN_2800 | 10160 | TTCN_1106 | 4230 | GTCN_1585 | 10203 |
| TTCN_1092 | 4188 | TTCN_3107 | 10161 | TTCN_1107 | 4231 | GTCN_1586 | 10204 |
| CTCN_1148 | 4189 | ATCN_2124 | 10162 | TTCN_1108 | 4232 | ATCN_2129 | 10205 |
| CTCN_1149 | 4190 | TTCN_3108 | 10163 | ATCN_771 | 4233 | GTCN_1587 | 10206 |
| ATCN_765 | 4191 | TTCN_3109 | 10164 | GTCN_640 | 4234 | TTCN_3132 | 10207 |
| CTCN_1150 | 4192 | CTCN_2801 | 10165 | TTCN_1109 | 4235 | ATCN_2130 | 10208 |
| CTCN_1151 | 4193 | TTCN_3110 | 10166 | ATCN_772 | 4236 | ATCN_2131 | 10209 |
| GTCN_632 | 4194 | CTCN_2802 | 10167 | GTCN_641 | 4237 | ATCN_2132 | 10210 |
| TTCN_1093 | 4195 | GTCN_1578 | 10168 | ATCN_773 | 4238 | TTCN_3133 | 10211 |
| GTCN_633 | 4196 | TTCN_3111 | 10169 | CTCN_1162 | 4239 | ATCN_2133 | 10212 |
| CTCN_1152 | 4197 | ATCN_2125 | 10170 | TTCN_1110 | 4240 | ATCN_2134 | 10213 |
| TTCN_1094 | 4198 | GTCN_1579 | 10171 | TTCN_1111 | 4241 | ATCN_2135 | 10214 |
| CTCN_1153 | 4199 | ATCN_2126 | 10172 | TTCN_1112 | 4242 | TTCN_3134 | 10215 |
| GTCN_634 | 4200 | TTCN_3112 | 10173 | CTCN_1163 | 4243 | GTCN_1588 | 10216 |
| CTCN_1154 | 4201 | TTCN_3113 | 10174 | CTCN_1164 | 4244 | CTCN_2806 | 10217 |
| ATCN_766 | 4202 | TTCN_3114 | 10175 | TTCN_1113 | 4245 | CTCN_2807 | 10218 |

FIG. 33 (continued)

| | | | | | | | |
|---|---|---|---|---|---|---|---|
| TTCN_1114 | 4246 | ATCN_2136 | 10219 | TTCN_1126 | 4289 | TTCN_3150 | 10262 |
| TTCN_1115 | 4247 | ATCN_2137 | 10220 | TTCN_1127 | 4290 | ATCN_2150 | 10263 |
| ATCN_774 | 4248 | GTCN_1589 | 10221 | ATCN_784 | 4291 | ATCN_2151 | 10264 |
| ATCN_775 | 4249 | CTCN_2808 | 10222 | TTCN_1128 | 4292 | GTCN_1594 | 10265 |
| GTCN_642 | 4250 | TTCN_3135 | 10223 | CTCN_1176 | 4293 | CTCN_2817 | 10266 |
| TTCN_1116 | 4251 | TTCN_3136 | 10224 | CTCN_1177 | 4294 | CTCN_2818 | 10267 |
| TTCN_1117 | 4252 | CTCN_2809 | 10225 | CTCN_1178 | 4295 | CTCN_2819 | 10268 |
| CTCN_1165 | 4253 | TTCN_3137 | 10226 | TTCN_1129 | 4296 | ATCN_2152 | 10269 |
| GTCN_643 | 4254 | TTCN_3138 | 10227 | CTCN_1179 | 4297 | CTCN_2820 | 10270 |
| CTCN_1166 | 4255 | GTCN_1590 | 10228 | CTCN_1180 | 4298 | TTCN_3151 | 10271 |
| GTCN_644 | 4256 | ATCN_2138 | 10229 | TTCN_1130 | 4299 | ATCN_2153 | 10272 |
| ATCN_776 | 4257 | TTCN_3139 | 10230 | ATCN_785 | 4300 | CTCN_2821 | 10273 |
| ATCN_777 | 4258 | CTCN_2810 | 10231 | CTCN_1181 | 4301 | TTCN_3152 | 10274 |
| TTCN_1118 | 4259 | TTCN_3140 | 10232 | TTCN_1131 | 4302 | TTCN_3153 | 10275 |
| ATCN_778 | 4260 | CTCN_2811 | 10233 | GTCN_652 | 4303 | GTCN_1595 | 10276 |
| CTCN_1167 | 4261 | TTCN_3141 | 10234 | CTCN_1182 | 4304 | ATCN_2154 | 10277 |
| ATCN_779 | 4262 | GTCN_1591 | 10235 | ATCN_786 | 4305 | TTCN_3154 | 10278 |
| CTCN_1168 | 4263 | CTCN_2812 | 10236 | TTCN_1132 | 4306 | TTCN_3155 | 10279 |
| GTCN_645 | 4264 | TTCN_3142 | 10237 | CTCN_1183 | 4307 | GTCN_1596 | 10280 |
| ATCN_780 | 4265 | TTCN_3143 | 10238 | TTCN_1133 | 4308 | GTCN_1597 | 10281 |
| TTCN_1119 | 4266 | ATCN_2139 | 10239 | ATCN_787 | 4309 | CTCN_2822 | 10282 |
| GTCN_646 | 4267 | ATCN_2140 | 10240 | GTCN_653 | 4310 | TTCN_3156 | 10283 |
| TTCN_1120 | 4268 | CTCN_2813 | 10241 | TTCN_1134 | 4311 | TTCN_3157 | 10284 |
| GTCN_647 | 4269 | CTCN_2814 | 10242 | TTCN_1135 | 4312 | CTCN_2823 | 10285 |
| TTCN_1121 | 4270 | TTCN_3144 | 10243 | GTCN_654 | 4313 | TTCN_3158 | 10286 |
| TTCN_1122 | 4271 | GTCN_1592 | 10244 | TTCN_1136 | 4314 | TTCN_3159 | 10287 |
| CTCN_1169 | 4272 | TTCN_3145 | 10245 | CTCN_1184 | 4315 | ATCN_2155 | 10288 |
| ATCN_781 | 4273 | CTCN_2815 | 10246 | CTCN_1185 | 4316 | ATCN_2156 | 10289 |
| CTCN_1170 | 4274 | ATCN_2141 | 10247 | TTCN_1137 | 4317 | TTCN_3160 | 10290 |
| CTCN_1171 | 4275 | ATCN_2142 | 10248 | GTCN_655 | 4318 | TTCN_3161 | 10291 |
| CTCN_1172 | 4276 | ATCN_2143 | 10249 | CTCN_1186 | 4319 | ATCN_2157 | 10292 |
| TTCN_1123 | 4277 | TTCN_3146 | 10250 | ATCN_788 | 4320 | TTCN_3162 | 10293 |
| TTCN_1124 | 4278 | ATCN_2144 | 10251 | GTCN_656 | 4321 | CTCN_2824 | 10294 |
| CTCN_1173 | 4279 | TTCN_3147 | 10252 | ATCN_789 | 4322 | CTCN_2825 | 10295 |
| ATCN_782 | 4280 | ATCN_2145 | 10253 | CTCN_1187 | 4323 | TTCN_3163 | 10296 |
| GTCN_648 | 4281 | GTCN_1593 | 10254 | TTCN_1138 | 4324 | TTCN_3164 | 10297 |
| CTCN_1174 | 4282 | CTCN_2816 | 10255 | GTCN_657 | 4325 | TTCN_3165 | 10298 |
| GTCN_649 | 4283 | ATCN_2146 | 10256 | CTCN_1188 | 4326 | TTCN_3166 | 10299 |
| CTCN_1175 | 4284 | ATCN_2147 | 10257 | TTCN_1139 | 4327 | CTCN_2826 | 10300 |
| TTCN_1125 | 4285 | TTCN_3148 | 10258 | ATCN_790 | 4328 | GTCN_1598 | 10301 |
| GTCN_650 | 4286 | ATCN_2148 | 10259 | CTCN_1189 | 4329 | TTCN_3167 | 10302 |
| ATCN_783 | 4287 | ATCN_2149 | 10260 | TTCN_1140 | 4330 | TTCN_3168 | 10303 |
| GTCN_651 | 4288 | TTCN_3149 | 10261 | CTCN_1190 | 4331 | CTCN_2827 | 10304 |

FIG. 33 (continued)

| | | | | | | | |
|---|---|---|---|---|---|---|---|
| GTCN_658 | 4332 | TTCN_3169 | 10305 | CTCN_1207 | 4375 | ATCN_2168 | 10348 |
| TTCN_1141 | 4333 | GTCN_1599 | 10306 | ATCN_802 | 4376 | TTCN_3186 | 10349 |
| TTCN_1142 | 4334 | TTCN_3170 | 10307 | CTCN_1208 | 4377 | GTCN_1604 | 10350 |
| ATCN_791 | 4335 | CTCN_2828 | 10308 | CTCN_1209 | 4378 | GTCN_1605 | 10351 |
| ATCN_792 | 4336 | TTCN_3171 | 10309 | TTCN_1150 | 4379 | TTCN_3187 | 10352 |
| TTCN_1143 | 4337 | TTCN_3172 | 10310 | ATCN_803 | 4380 | ATCN_2169 | 10353 |
| GTCN_659 | 4338 | ATCN_2158 | 10311 | CTCN_1210 | 4381 | TTCN_3188 | 10354 |
| CTCN_1191 | 4339 | ATCN_2159 | 10312 | CTCN_1211 | 4382 | TTCN_3189 | 10355 |
| CTCN_1192 | 4340 | TTCN_3173 | 10313 | ATCN_804 | 4383 | TTCN_3190 | 10356 |
| ATCN_793 | 4341 | TTCN_3174 | 10314 | ATCN_805 | 4384 | GTCN_1606 | 10357 |
| ATCN_794 | 4342 | TTCN_3175 | 10315 | CTCN_1212 | 4385 | CTCN_2839 | 10358 |
| CTCN_1193 | 4343 | TTCN_3176 | 10316 | GTCN_665 | 4386 | TTCN_3191 | 10359 |
| TTCN_1144 | 4344 | GTCN_1600 | 10317 | CTCN_1213 | 4387 | CTCN_2840 | 10360 |
| CTCN_1194 | 4345 | CTCN_2829 | 10318 | ATCN_806 | 4388 | TTCN_3192 | 10361 |
| ATCN_795 | 4346 | ATCN_2160 | 10319 | CTCN_1214 | 4389 | CTCN_2841 | 10362 |
| CTCN_1195 | 4347 | TTCN_3177 | 10320 | GTCN_666 | 4390 | GTCN_1607 | 10363 |
| CTCN_1196 | 4348 | CTCN_2830 | 10321 | ATCN_807 | 4391 | TTCN_3193 | 10364 |
| ATCN_796 | 4349 | ATCN_2161 | 10322 | TTCN_1151 | 4392 | ATCN_2170 | 10365 |
| ATCN_797 | 4350 | CTCN_2831 | 10323 | GTCN_667 | 4393 | TTCN_3194 | 10366 |
| CTCN_1197 | 4351 | TTCN_3178 | 10324 | CTCN_1215 | 4394 | ATCN_2171 | 10367 |
| GTCN_660 | 4352 | TTCN_3179 | 10325 | CTCN_1216 | 4395 | CTCN_2842 | 10368 |
| CTCN_1198 | 4353 | GTCN_1601 | 10326 | GTCN_668 | 4396 | TTCN_3195 | 10369 |
| GTCN_661 | 4354 | CTCN_2832 | 10327 | CTCN_1217 | 4397 | CTCN_2843 | 10370 |
| GTCN_662 | 4355 | CTCN_2833 | 10328 | CTCN_1218 | 4398 | ATCN_2172 | 10371 |
| CTCN_1199 | 4356 | CTCN_2834 | 10329 | CTCN_1219 | 4399 | TTCN_3196 | 10372 |
| TTCN_1145 | 4357 | CTCN_2835 | 10330 | CTCN_1220 | 4400 | ATCN_2173 | 10373 |
| TTCN_1146 | 4358 | ATCN_2162 | 10331 | TTCN_1152 | 4401 | CTCN_2844 | 10374 |
| GTCN_663 | 4359 | TTCN_3180 | 10332 | TTCN_1153 | 4402 | CTCN_2845 | 10375 |
| GTCN_664 | 4360 | TTCN_3181 | 10333 | ATCN_808 | 4403 | CTCN_2846 | 10376 |
| CTCN_1200 | 4361 | GTCN_1602 | 10334 | CTCN_1221 | 4404 | GTCN_1608 | 10377 |
| CTCN_1201 | 4362 | TTCN_3182 | 10335 | CTCN_1222 | 4405 | ATCN_2174 | 10378 |
| TTCN_1147 | 4363 | TTCN_3183 | 10336 | CTCN_1223 | 4406 | ATCN_2175 | 10379 |
| ATCN_798 | 4364 | ATCN_2163 | 10337 | CTCN_1224 | 4407 | ATCN_2176 | 10380 |
| TTCN_1148 | 4365 | CTCN_2836 | 10338 | ATCN_809 | 4408 | TTCN_3197 | 10381 |
| ATCN_799 | 4366 | GTCN_1603 | 10339 | CTCN_1225 | 4409 | TTCN_3198 | 10382 |
| CTCN_1202 | 4367 | ATCN_2164 | 10340 | GTCN_669 | 4410 | ATCN_2177 | 10383 |
| CTCN_1203 | 4368 | TTCN_3184 | 10341 | CTCN_1226 | 4411 | CTCN_2847 | 10384 |
| CTCN_1204 | 4369 | ATCN_2165 | 10342 | CTCN_1227 | 4412 | CTCN_2848 | 10385 |
| ATCN_800 | 4370 | TTCN_3185 | 10343 | GTCN_670 | 4413 | ATCN_2178 | 10386 |
| ATCN_801 | 4371 | ATCN_2166 | 10344 | CTCN_1228 | 4414 | TTCN_3199 | 10387 |
| CTCN_1205 | 4372 | ATCN_2167 | 10345 | ATCN_810 | 4415 | GTCN_1609 | 10388 |
| CTCN_1206 | 4373 | CTCN_2837 | 10346 | CTCN_1229 | 4416 | TTCN_3200 | 10389 |
| TTCN_1149 | 4374 | CTCN_2838 | 10347 | TTCN_1154 | 4417 | CTCN_2849 | 10390 |

FIG. 33 (continued)

| | | | | | | | |
|---|---|---|---|---|---|---|---|
| CTCN_1230 | 4418 | ATCN_2179 | 10391 | CTCN_1245 | 4461 | ATCN_2190 | 10434 |
| GTCN_671 | 4419 | ATCN_2180 | 10392 | TTCN_1175 | 4462 | TTCN_3213 | 10435 |
| TTCN_1155 | 4420 | TTCN_3201 | 10393 | ATCN_814 | 4463 | CTCN_2862 | 10436 |
| TTCN_1156 | 4421 | ATCN_2181 | 10394 | CTCN_1246 | 4464 | TTCN_3214 | 10437 |
| TTCN_1157 | 4422 | TTCN_3202 | 10395 | ATCN_815 | 4465 | ATCN_2191 | 10438 |
| CTCN_1231 | 4423 | GTCN_1610 | 10396 | CTCN_1247 | 4466 | GTCN_1618 | 10439 |
| TTCN_1158 | 4424 | CTCN_2850 | 10397 | TTCN_1176 | 4467 | CTCN_2863 | 10440 |
| ATCN_811 | 4425 | TTCN_3203 | 10398 | ATCN_816 | 4468 | TTCN_3215 | 10441 |
| CTCN_1232 | 4426 | GTCN_1611 | 10399 | TTCN_1177 | 4469 | TTCN_3216 | 10442 |
| TTCN_1159 | 4427 | CTCN_2851 | 10400 | TTCN_1178 | 4470 | ATCN_2192 | 10443 |
| CTCN_1233 | 4428 | GTCN_1612 | 10401 | ATCN_817 | 4471 | TTCN_3217 | 10444 |
| CTCN_1234 | 4429 | CTCN_2852 | 10402 | GTCN_676 | 4472 | CTCN_2864 | 10445 |
| TTCN_1160 | 4430 | ATCN_2182 | 10403 | TTCN_1179 | 4473 | ATCN_2193 | 10446 |
| TTCN_1161 | 4431 | TTCN_3204 | 10404 | TTCN_1180 | 4474 | CTCN_2865 | 10447 |
| CTCN_1235 | 4432 | GTCN_1613 | 10405 | TTCN_1181 | 4475 | ATCN_2194 | 10448 |
| TTCN_1162 | 4433 | ATCN_2183 | 10406 | GTCN_677 | 4476 | TTCN_3218 | 10449 |
| TTCN_1163 | 4434 | ATCN_2184 | 10407 | CTCN_1248 | 4477 | ATCN_2195 | 10450 |
| CTCN_1236 | 4435 | TTCN_3205 | 10408 | ATCN_818 | 4478 | ATCN_2196 | 10451 |
| CTCN_1237 | 4436 | TTCN_3206 | 10409 | CTCN_1249 | 4479 | TTCN_3219 | 10452 |
| CTCN_1238 | 4437 | TTCN_3207 | 10410 | CTCN_1250 | 4480 | CTCN_2866 | 10453 |
| CTCN_1239 | 4438 | TTCN_3208 | 10411 | CTCN_1251 | 4481 | TTCN_3220 | 10454 |
| CTCN_1240 | 4439 | CTCN_2853 | 10412 | CTCN_1252 | 4482 | TTCN_3221 | 10455 |
| CTCN_1241 | 4440 | TTCN_3209 | 10413 | TTCN_1182 | 4483 | ATCN_2197 | 10456 |
| TTCN_1164 | 4441 | ATCN_2185 | 10414 | GTCN_678 | 4484 | ATCN_2198 | 10457 |
| TTCN_1165 | 4442 | TTCN_3210 | 10415 | CTCN_1253 | 4485 | ATCN_2199 | 10458 |
| TTCN_1166 | 4443 | TTCN_3211 | 10416 | GTCN_679 | 4486 | GTCN_1619 | 10459 |
| CTCN_1242 | 4444 | ATCN_2186 | 10417 | CTCN_1254 | 4487 | TTCN_3222 | 10460 |
| GTCN_672 | 4445 | CTCN_2854 | 10418 | ATCN_819 | 4488 | CTCN_2867 | 10461 |
| TTCN_1167 | 4446 | ATCN_2187 | 10419 | ATCN_820 | 4489 | TTCN_3223 | 10462 |
| ATCN_812 | 4447 | GTCN_1614 | 10420 | GTCN_680 | 4490 | TTCN_3224 | 10463 |
| TTCN_1168 | 4448 | CTCN_2855 | 10421 | TTCN_1183 | 4491 | TTCN_3225 | 10464 |
| TTCN_1169 | 4449 | CTCN_2856 | 10422 | GTCN_681 | 4492 | TTCN_3226 | 10465 |
| TTCN_1170 | 4450 | GTCN_1615 | 10423 | TTCN_1184 | 4493 | CTCN_2868 | 10466 |
| TTCN_1171 | 4451 | CTCN_2857 | 10424 | TTCN_1185 | 4494 | ATCN_2200 | 10467 |
| GTCN_673 | 4452 | ATCN_2188 | 10425 | TTCN_1186 | 4495 | TTCN_3227 | 10468 |
| ATCN_813 | 4453 | TTCN_3212 | 10426 | GTCN_682 | 4496 | ATCN_2201 | 10469 |
| CTCN_1243 | 4454 | GTCN_1616 | 10427 | CTCN_1255 | 4497 | ATCN_2202 | 10470 |
| CTCN_1244 | 4455 | GTCN_1617 | 10428 | TTCN_1187 | 4498 | ATCN_2203 | 10471 |
| TTCN_1172 | 4456 | CTCN_2858 | 10429 | TTCN_1188 | 4499 | ATCN_2204 | 10472 |
| GTCN_674 | 4457 | CTCN_2859 | 10430 | ATCN_821 | 4500 | ATCN_2205 | 10473 |
| TTCN_1173 | 4458 | CTCN_2860 | 10431 | CTCN_1256 | 4501 | TTCN_3228 | 10474 |
| GTCN_675 | 4459 | CTCN_2861 | 10432 | CTCN_1257 | 4502 | GTCN_1620 | 10475 |
| TTCN_1174 | 4460 | ATCN_2189 | 10433 | GTCN_683 | 4503 | TTCN_3229 | 10476 |

FIG. 33 (continued)

| CTCN_1258 | 4504 | TTCN_3230 | 10477 | ATCN_833 | 4547 | ATCN_2213 | 10520 |
|---|---|---|---|---|---|---|---|
| ATCN_822 | 4505 | TTCN_3231 | 10478 | TTCN_1197 | 4548 | CTCN_2884 | 10521 |
| CTCN_1259 | 4506 | CTCN_2869 | 10479 | GTCN_691 | 4549 | CTCN_2885 | 10522 |
| CTCN_1260 | 4507 | ATCN_2206 | 10480 | CTCN_1275 | 4550 | CTCN_2886 | 10523 |
| GTCN_684 | 4508 | ATCN_2207 | 10481 | TTCN_1198 | 4551 | CTCN_2887 | 10524 |
| ATCN_823 | 4509 | GTCN_1621 | 10482 | CTCN_1276 | 4552 | CTCN_2888 | 10525 |
| ATCN_824 | 4510 | ATCN_2208 | 10483 | TTCN_1199 | 4553 | ATCN_2214 | 10526 |
| CTCN_1261 | 4511 | GTCN_1622 | 10484 | TTCN_1200 | 4554 | TTCN_3240 | 10527 |
| GTCN_685 | 4512 | CTCN_2870 | 10485 | ATCN_834 | 4555 | TTCN_3241 | 10528 |
| CTCN_1262 | 4513 | TTCN_3232 | 10486 | CTCN_1277 | 4556 | GTCN_1632 | 10529 |
| ATCN_825 | 4514 | TTCN_3233 | 10487 | TTCN_1201 | 4557 | TTCN_3242 | 10530 |
| ATCN_826 | 4515 | CTCN_2871 | 10488 | CTCN_1278 | 4558 | TTCN_3243 | 10531 |
| CTCN_1263 | 4516 | GTCN_1623 | 10489 | TTCN_1202 | 4559 | CTCN_2889 | 10532 |
| GTCN_686 | 4517 | CTCN_2872 | 10490 | CTCN_1279 | 4560 | GTCN_1633 | 10533 |
| ATCN_827 | 4518 | CTCN_2873 | 10491 | TTCN_1203 | 4561 | TTCN_3244 | 10534 |
| TTCN_1189 | 4519 | GTCN_1624 | 10492 | ATCN_835 | 4562 | GTCN_1634 | 10535 |
| ATCN_828 | 4520 | CTCN_2874 | 10493 | TTCN_1204 | 4563 | ATCN_2215 | 10536 |
| ATCN_829 | 4521 | ATCN_2209 | 10494 | ATCN_836 | 4564 | ATCN_2216 | 10537 |
| CTCN_1264 | 4522 | CTCN_2875 | 10495 | TTCN_1205 | 4565 | CTCN_2890 | 10538 |
| CTCN_1265 | 4523 | CTCN_2876 | 10496 | ATCN_837 | 4566 | TTCN_3245 | 10539 |
| GTCN_687 | 4524 | CTCN_2877 | 10497 | ATCN_838 | 4567 | TTCN_3246 | 10540 |
| CTCN_1266 | 4525 | CTCN_2878 | 10498 | ATCN_839 | 4568 | ATCN_2217 | 10541 |
| TTCN_1190 | 4526 | GTCN_1625 | 10499 | ATCN_840 | 4569 | ATCN_2218 | 10542 |
| CTCN_1267 | 4527 | GTCN_1626 | 10500 | GTCN_692 | 4570 | GTCN_1635 | 10543 |
| TTCN_1191 | 4528 | CTCN_2879 | 10501 | CTCN_1280 | 4571 | ATCN_2219 | 10544 |
| TTCN_1192 | 4529 | GTCN_1627 | 10502 | TTCN_1206 | 4572 | ATCN_2220 | 10545 |
| ATCN_830 | 4530 | CTCN_2880 | 10503 | CTCN_1281 | 4573 | CTCN_2891 | 10546 |
| CTCN_1268 | 4531 | TTCN_3234 | 10504 | ATCN_841 | 4574 | ATCN_2221 | 10547 |
| CTCN_1269 | 4532 | GTCN_1628 | 10505 | CTCN_1282 | 4575 | CTCN_2892 | 10548 |
| CTCN_1270 | 4533 | TTCN_3235 | 10506 | ATCN_842 | 4576 | CTCN_2893 | 10549 |
| ATCN_831 | 4534 | TTCN_3236 | 10507 | GTCN_693 | 4577 | ATCN_2222 | 10550 |
| ATCN_832 | 4535 | CTCN_2881 | 10508 | TTCN_1207 | 4578 | ATCN_2223 | 10551 |
| CTCN_1271 | 4536 | GTCN_1629 | 10509 | TTCN_1208 | 4579 | CTCN_2894 | 10552 |
| GTCN_688 | 4537 | TTCN_3237 | 10510 | TTCN_1209 | 4580 | GTCN_1636 | 10553 |
| CTCN_1272 | 4538 | TTCN_3238 | 10511 | ATCN_843 | 4581 | CTCN_2895 | 10554 |
| CTCN_1273 | 4539 | GTCN_1630 | 10512 | TTCN_1210 | 4582 | ATCN_2224 | 10555 |
| GTCN_689 | 4540 | ATCN_2210 | 10513 | CTCN_1283 | 4583 | ATCN_2225 | 10556 |
| CTCN_1274 | 4541 | ATCN_2211 | 10514 | CTCN_1284 | 4584 | GTCN_1637 | 10557 |
| GTCN_690 | 4542 | CTCN_2882 | 10515 | TTCN_1211 | 4585 | TTCN_3247 | 10558 |
| TTCN_1193 | 4543 | TTCN_3239 | 10516 | CTCN_1285 | 4586 | CTCN_2896 | 10559 |
| TTCN_1194 | 4544 | GTCN_1631 | 10517 | GTCN_694 | 4587 | TTCN_3248 | 10560 |
| TTCN_1195 | 4545 | CTCN_2883 | 10518 | TTCN_1212 | 4588 | TTCN_3249 | 10561 |
| TTCN_1196 | 4546 | ATCN_2212 | 10519 | CTCN_1286 | 4589 | TTCN_3250 | 10562 |

FIG. 33 (continued)

| | | | | | | | |
|---|---|---|---|---|---|---|---|
| CTCN_1287 | 4590 | TTCN_3251 | 10563 | ATCN_854 | 4633 | TTCN_3266 | 10606 |
| CTCN_1288 | 4591 | TTCN_3252 | 10564 | ATCN_855 | 4634 | TTCN_3267 | 10607 |
| CTCN_1289 | 4592 | TTCN_3253 | 10565 | GTCN_702 | 4635 | CTCN_2906 | 10608 |
| TTCN_1213 | 4593 | GTCN_1638 | 10566 | CTCN_1301 | 4636 | GTCN_1643 | 10609 |
| ATCN_844 | 4594 | ATCN_2226 | 10567 | TTCN_1225 | 4637 | GTCN_1644 | 10610 |
| CTCN_1290 | 4595 | CTCN_2897 | 10568 | GTCN_703 | 4638 | GTCN_1645 | 10611 |
| CTCN_1291 | 4596 | TTCN_3254 | 10569 | TTCN_1226 | 4639 | CTCN_2907 | 10612 |
| TTCN_1214 | 4597 | TTCN_3255 | 10570 | TTCN_1227 | 4640 | ATCN_2240 | 10613 |
| TTCN_1215 | 4598 | TTCN_3256 | 10571 | ATCN_856 | 4641 | GTCN_1646 | 10614 |
| GTCN_695 | 4599 | CTCN_2898 | 10572 | TTCN_1228 | 4642 | GTCN_1647 | 10615 |
| GTCN_696 | 4600 | ATCN_2227 | 10573 | GTCN_704 | 4643 | TTCN_3268 | 10616 |
| CTCN_1292 | 4601 | TTCN_3257 | 10574 | ATCN_857 | 4644 | ATCN_2241 | 10617 |
| GTCN_697 | 4602 | GTCN_1639 | 10575 | ATCN_858 | 4645 | CTCN_2908 | 10618 |
| ATCN_845 | 4603 | CTCN_2899 | 10576 | CTCN_1302 | 4646 | TTCN_3269 | 10619 |
| CTCN_1293 | 4604 | CTCN_2900 | 10577 | CTCN_1303 | 4647 | GTCN_1648 | 10620 |
| TTCN_1216 | 4605 | ATCN_2228 | 10578 | GTCN_705 | 4648 | CTCN_2909 | 10621 |
| GTCN_698 | 4606 | ATCN_2229 | 10579 | CTCN_1304 | 4649 | CTCN_2910 | 10622 |
| CTCN_1294 | 4607 | TTCN_3258 | 10580 | CTCN_1305 | 4650 | TTCN_3270 | 10623 |
| ATCN_846 | 4608 | ATCN_2230 | 10581 | CTCN_1306 | 4651 | ATCN_2242 | 10624 |
| TTCN_1217 | 4609 | TTCN_3259 | 10582 | ATCN_859 | 4652 | ATCN_2243 | 10625 |
| ATCN_847 | 4610 | CTCN_2901 | 10583 | ATCN_860 | 4653 | ATCN_2244 | 10626 |
| ATCN_848 | 4611 | TTCN_3260 | 10584 | ATCN_861 | 4654 | ATCN_2245 | 10627 |
| CTCN_1295 | 4612 | GTCN_1640 | 10585 | CTCN_1307 | 4655 | CTCN_2911 | 10628 |
| CTCN_1296 | 4613 | TTCN_3261 | 10586 | GTCN_706 | 4656 | CTCN_2912 | 10629 |
| CTCN_1297 | 4614 | ATCN_2231 | 10587 | CTCN_1308 | 4657 | ATCN_2246 | 10630 |
| TTCN_1218 | 4615 | TTCN_3262 | 10588 | CTCN_1309 | 4658 | TTCN_3271 | 10631 |
| CTCN_1298 | 4616 | TTCN_3263 | 10589 | GTCN_707 | 4659 | ATCN_2247 | 10632 |
| CTCN_1299 | 4617 | ATCN_2232 | 10590 | CTCN_1310 | 4660 | TTCN_3272 | 10633 |
| ATCN_849 | 4618 | TTCN_3264 | 10591 | TTCN_1229 | 4661 | TTCN_3273 | 10634 |
| ATCN_850 | 4619 | TTCN_3265 | 10592 | ATCN_862 | 4662 | ATCN_2248 | 10635 |
| GTCN_699 | 4620 | CTCN_2902 | 10593 | ATCN_863 | 4663 | TTCN_3274 | 10636 |
| TTCN_1219 | 4621 | ATCN_2233 | 10594 | CTCN_1311 | 4664 | TTCN_3275 | 10637 |
| CTCN_1300 | 4622 | ATCN_2234 | 10595 | CTCN_1312 | 4665 | TTCN_3276 | 10638 |
| GTCN_700 | 4623 | CTCN_2903 | 10596 | CTCN_1313 | 4666 | CTCN_2913 | 10639 |
| TTCN_1220 | 4624 | CTCN_2904 | 10597 | ATCN_864 | 4667 | TTCN_3277 | 10640 |
| TTCN_1221 | 4625 | CTCN_2905 | 10598 | ATCN_865 | 4668 | CTCN_2914 | 10641 |
| TTCN_1222 | 4626 | ATCN_2235 | 10599 | CTCN_1314 | 4669 | TTCN_3278 | 10642 |
| ATCN_851 | 4627 | GTCN_1641 | 10600 | GTCN_708 | 4670 | ATCN_2249 | 10643 |
| TTCN_1223 | 4628 | ATCN_2236 | 10601 | CTCN_1315 | 4671 | ATCN_2250 | 10644 |
| GTCN_701 | 4629 | ATCN_2237 | 10602 | GTCN_709 | 4672 | TTCN_3279 | 10645 |
| TTCN_1224 | 4630 | GTCN_1642 | 10603 | CTCN_1316 | 4673 | CTCN_2915 | 10646 |
| ATCN_852 | 4631 | ATCN_2238 | 10604 | CTCN_1317 | 4674 | ATCN_2251 | 10647 |
| ATCN_853 | 4632 | ATCN_2239 | 10605 | GTCN_710 | 4675 | TTCN_3280 | 10648 |

FIG. 33 (continued)

| | | | | | | | |
|---|---|---|---|---|---|---|---|
| GTCN_711 | 4676 | CTCN_2916 | 10649 | CTCN_1328 | 4719 | TTCN_3304 | 10692 |
| CTCN_1318 | 4677 | CTCN_2917 | 10650 | GTCN_722 | 4720 | ATCN_2262 | 10693 |
| CTCN_1319 | 4678 | CTCN_2918 | 10651 | CTCN_1329 | 4721 | TTCN_3305 | 10694 |
| CTCN_1320 | 4679 | TTCN_3281 | 10652 | CTCN_1330 | 4722 | TTCN_3306 | 10695 |
| GTCN_712 | 4680 | CTCN_2919 | 10653 | TTCN_1241 | 4723 | TTCN_3307 | 10696 |
| ATCN_866 | 4681 | CTCN_2920 | 10654 | CTCN_1331 | 4724 | ATCN_2263 | 10697 |
| GTCN_713 | 4682 | TTCN_3282 | 10655 | TTCN_1242 | 4725 | TTCN_3308 | 10698 |
| TTCN_1230 | 4683 | TTCN_3283 | 10656 | GTCN_723 | 4726 | TTCN_3309 | 10699 |
| CTCN_1321 | 4684 | GTCN_1649 | 10657 | TTCN_1243 | 4727 | TTCN_3310 | 10700 |
| GTCN_714 | 4685 | TTCN_3284 | 10658 | TTCN_1244 | 4728 | CTCN_2923 | 10701 |
| CTCN_1322 | 4686 | TTCN_3285 | 10659 | ATCN_877 | 4729 | TTCN_3311 | 10702 |
| TTCN_1231 | 4687 | TTCN_3286 | 10660 | TTCN_1245 | 4730 | TTCN_3312 | 10703 |
| ATCN_867 | 4688 | TTCN_3287 | 10661 | ATCN_878 | 4731 | TTCN_3313 | 10704 |
| CTCN_1323 | 4689 | TTCN_3288 | 10662 | CTCN_1332 | 4732 | CTCN_2924 | 10705 |
| GTCN_715 | 4690 | TTCN_3289 | 10663 | TTCN_1246 | 4733 | TTCN_3314 | 10706 |
| GTCN_716 | 4691 | ATCN_2252 | 10664 | ATCN_879 | 4734 | CTCN_2925 | 10707 |
| TTCN_1232 | 4692 | TTCN_3290 | 10665 | TTCN_1247 | 4735 | ATCN_2264 | 10708 |
| GTCN_717 | 4693 | CTCN_2921 | 10666 | TTCN_1248 | 4736 | CTCN_2926 | 10709 |
| ATCN_868 | 4694 | GTCN_1650 | 10667 | GTCN_724 | 4737 | TTCN_3315 | 10710 |
| CTCN_1324 | 4695 | ATCN_2253 | 10668 | TTCN_1249 | 4738 | TTCN_3316 | 10711 |
| TTCN_1233 | 4696 | TTCN_3291 | 10669 | GTCN_725 | 4739 | TTCN_3317 | 10712 |
| TTCN_1234 | 4697 | TTCN_3292 | 10670 | ATCN_880 | 4740 | TTCN_3318 | 10713 |
| CTCN_1325 | 4698 | TTCN_3293 | 10671 | TTCN_1250 | 4741 | TTCN_3319 | 10714 |
| ATCN_869 | 4699 | ATCN_2254 | 10672 | GTCN_726 | 4742 | CTCN_2927 | 10715 |
| TTCN_1235 | 4700 | TTCN_3294 | 10673 | ATCN_881 | 4743 | CTCN_2928 | 10716 |
| ATCN_870 | 4701 | TTCN_3295 | 10674 | ATCN_882 | 4744 | CTCN_2929 | 10717 |
| GTCN_718 | 4702 | ATCN_2255 | 10675 | CTCN_1333 | 4745 | TTCN_3320 | 10718 |
| TTCN_1236 | 4703 | TTCN_3296 | 10676 | CTCN_1334 | 4746 | TTCN_3321 | 10719 |
| CTCN_1326 | 4704 | ATCN_2256 | 10677 | ATCN_883 | 4747 | TTCN_3322 | 10720 |
| ATCN_871 | 4705 | TTCN_3297 | 10678 | TTCN_1251 | 4748 | TTCN_3323 | 10721 |
| ATCN_872 | 4706 | ATCN_2257 | 10679 | TTCN_1252 | 4749 | ATCN_2265 | 10722 |
| TTCN_1237 | 4707 | GTCN_1651 | 10680 | ATCN_884 | 4750 | TTCN_3324 | 10723 |
| TTCN_1238 | 4708 | TTCN_3298 | 10681 | CTCN_1335 | 4751 | TTCN_3325 | 10724 |
| ATCN_873 | 4709 | TTCN_3299 | 10682 | TTCN_1253 | 4752 | CTCN_2930 | 10725 |
| TTCN_1239 | 4710 | ATCN_2258 | 10683 | CTCN_1336 | 4753 | ATCN_2266 | 10726 |
| GTCN_719 | 4711 | TTCN_3300 | 10684 | CTCN_1337 | 4754 | TTCN_3326 | 10727 |
| ATCN_874 | 4712 | TTCN_3301 | 10685 | TTCN_1254 | 4755 | CTCN_2931 | 10728 |
| ATCN_875 | 4713 | ATCN_2259 | 10686 | ATCN_885 | 4756 | ATCN_2267 | 10729 |
| CTCN_1327 | 4714 | ATCN_2260 | 10687 | TTCN_1255 | 4757 | ATCN_2268 | 10730 |
| TTCN_1240 | 4715 | TTCN_3302 | 10688 | TTCN_1256 | 4758 | GTCN_1652 | 10731 |
| GTCN_720 | 4716 | ATCN_2261 | 10689 | CTCN_1338 | 4759 | TTCN_3327 | 10732 |
| ATCN_876 | 4717 | CTCN_2922 | 10690 | ATCN_886 | 4760 | ATCN_2269 | 10733 |
| GTCN_721 | 4718 | TTCN_3303 | 10691 | ATCN_887 | 4761 | ATCN_2270 | 10734 |

FIG. 33 (continued)

| | | | | | | | |
|---|---|---|---|---|---|---|---|
| TTCN_1257 | 4762 | TTCN_3328 | 10735 | TTCN_1277 | 4805 | ATCN_2285 | 10778 |
| ATCN_888 | 4763 | GTCN_1653 | 10736 | CTCN_1342 | 4806 | GTCN_1662 | 10779 |
| GTCN_727 | 4764 | GTCN_1654 | 10737 | TTCN_1278 | 4807 | CTCN_2939 | 10780 |
| TTCN_1258 | 4765 | TTCN_3329 | 10738 | TTCN_1279 | 4808 | CTCN_2940 | 10781 |
| TTCN_1259 | 4766 | ATCN_2271 | 10739 | CTCN_1343 | 4809 | TTCN_3341 | 10782 |
| TTCN_1260 | 4767 | TTCN_3330 | 10740 | TTCN_1280 | 4810 | ATCN_2286 | 10783 |
| GTCN_728 | 4768 | TTCN_3331 | 10741 | TTCN_1281 | 4811 | ATCN_2287 | 10784 |
| TTCN_1261 | 4769 | ATCN_2272 | 10742 | TTCN_1282 | 4812 | CTCN_2941 | 10785 |
| GTCN_729 | 4770 | ATCN_2273 | 10743 | TTCN_1283 | 4813 | TTCN_3342 | 10786 |
| TTCN_1262 | 4771 | GTCN_1655 | 10744 | TTCN_1284 | 4814 | CTCN_2942 | 10787 |
| TTCN_1263 | 4772 | CTCN_2932 | 10745 | CTCN_1344 | 4815 | TTCN_3343 | 10788 |
| TTCN_1264 | 4773 | TTCN_3332 | 10746 | GTCN_736 | 4816 | TTCN_3344 | 10789 |
| GTCN_730 | 4774 | GTCN_1656 | 10747 | ATCN_899 | 4817 | CTCN_2943 | 10790 |
| GTCN_731 | 4775 | ATCN_2274 | 10748 | CTCN_1345 | 4818 | CTCN_2944 | 10791 |
| ATCN_889 | 4776 | TTCN_3333 | 10749 | ATCN_900 | 4819 | TTCN_3345 | 10792 |
| TTCN_1265 | 4777 | ATCN_2275 | 10750 | CTCN_1346 | 4820 | GTCN_1663 | 10793 |
| GTCN_732 | 4778 | CTCN_2933 | 10751 | TTCN_1285 | 4821 | CTCN_2945 | 10794 |
| TTCN_1266 | 4779 | ATCN_2276 | 10752 | CTCN_1347 | 4822 | TTCN_3346 | 10795 |
| GTCN_733 | 4780 | ATCN_2277 | 10753 | CTCN_1348 | 4823 | CTCN_2946 | 10796 |
| TTCN_1267 | 4781 | ATCN_2278 | 10754 | ATCN_901 | 4824 | CTCN_2947 | 10797 |
| TTCN_1268 | 4782 | CTCN_2934 | 10755 | ATCN_902 | 4825 | ATCN_2288 | 10798 |
| ATCN_890 | 4783 | TTCN_3334 | 10756 | CTCN_1349 | 4826 | CTCN_2948 | 10799 |
| ATCN_891 | 4784 | ATCN_2279 | 10757 | GTCN_737 | 4827 | CTCN_2949 | 10800 |
| ATCN_892 | 4785 | TTCN_3335 | 10758 | CTCN_1350 | 4828 | CTCN_2950 | 10801 |
| CTCN_1339 | 4786 | ATCN_2280 | 10759 | ATCN_903 | 4829 | TTCN_3347 | 10802 |
| ATCN_893 | 4787 | TTCN_3336 | 10760 | CTCN_1351 | 4830 | CTCN_2951 | 10803 |
| GTCN_734 | 4788 | TTCN_3337 | 10761 | GTCN_738 | 4831 | GTCN_1664 | 10804 |
| TTCN_1269 | 4789 | GTCN_1657 | 10762 | ATCN_904 | 4832 | TTCN_3348 | 10805 |
| TTCN_1270 | 4790 | CTCN_2935 | 10763 | GTCN_739 | 4833 | GTCN_1665 | 10806 |
| TTCN_1271 | 4791 | GTCN_1658 | 10764 | CTCN_1352 | 4834 | CTCN_2952 | 10807 |
| TTCN_1272 | 4792 | TTCN_3338 | 10765 | TTCN_1286 | 4835 | TTCN_3349 | 10808 |
| ATCN_894 | 4793 | TTCN_3339 | 10766 | CTCN_1353 | 4836 | CTCN_2953 | 10809 |
| TTCN_1273 | 4794 | ATCN_2281 | 10767 | ATCN_905 | 4837 | TTCN_3350 | 10810 |
| CTCN_1340 | 4795 | ATCN_2282 | 10768 | CTCN_1354 | 4838 | CTCN_2954 | 10811 |
| ATCN_895 | 4796 | GTCN_1659 | 10769 | CTCN_1355 | 4839 | CTCN_2955 | 10812 |
| CTCN_1341 | 4797 | GTCN_1660 | 10770 | TTCN_1287 | 4840 | TTCN_3351 | 10813 |
| TTCN_1274 | 4798 | CTCN_2936 | 10771 | TTCN_1288 | 4841 | GTCN_1666 | 10814 |
| TTCN_1275 | 4799 | CTCN_2937 | 10772 | CTCN_1356 | 4842 | CTCN_2956 | 10815 |
| ATCN_896 | 4800 | CTCN_2938 | 10773 | CTCN_1357 | 4843 | CTCN_2957 | 10816 |
| ATCN_897 | 4801 | ATCN_2283 | 10774 | CTCN_1358 | 4844 | TTCN_3352 | 10817 |
| TTCN_1276 | 4802 | ATCN_2284 | 10775 | CTCN_1359 | 4845 | GTCN_1667 | 10818 |
| ATCN_898 | 4803 | TTCN_3340 | 10776 | CTCN_1360 | 4846 | CTCN_2958 | 10819 |
| GTCN_735 | 4804 | GTCN_1661 | 10777 | ATCN_906 | 4847 | CTCN_2959 | 10820 |

FIG. 33 (continued)

| | | | | | | | |
|---|---|---|---|---|---|---|---|
| ATCN_907 | 4848 | CTCN_2960 | 10821 | CTCN_1378 | 4891 | GTCN_1675 | 10864 |
| CTCN_1361 | 4849 | TTCN_3353 | 10822 | GTCN_747 | 4892 | CTCN_2980 | 10865 |
| GTCN_740 | 4850 | TTCN_3354 | 10823 | GTCN_748 | 4893 | CTCN_2981 | 10866 |
| CTCN_1362 | 4851 | ATCN_2289 | 10824 | GTCN_749 | 4894 | CTCN_2982 | 10867 |
| CTCN_1363 | 4852 | CTCN_2961 | 10825 | TTCN_1302 | 4895 | TTCN_3364 | 10868 |
| CTCN_1364 | 4853 | TTCN_3355 | 10826 | ATCN_913 | 4896 | CTCN_2983 | 10869 |
| GTCN_741 | 4854 | ATCN_2290 | 10827 | CTCN_1379 | 4897 | GTCN_1676 | 10870 |
| CTCN_1365 | 4855 | TTCN_3356 | 10828 | GTCN_750 | 4898 | GTCN_1677 | 10871 |
| GTCN_742 | 4856 | CTCN_2962 | 10829 | ATCN_914 | 4899 | CTCN_2984 | 10872 |
| CTCN_1366 | 4857 | TTCN_3357 | 10830 | ATCN_915 | 4900 | GTCN_1678 | 10873 |
| TTCN_1289 | 4858 | CTCN_2963 | 10831 | TTCN_1303 | 4901 | TTCN_3365 | 10874 |
| TTCN_1290 | 4859 | CTCN_2964 | 10832 | GTCN_751 | 4902 | GTCN_1679 | 10875 |
| CTCN_1367 | 4860 | GTCN_1668 | 10833 | TTCN_1304 | 4903 | GTCN_1680 | 10876 |
| GTCN_743 | 4861 | ATCN_2291 | 10834 | TTCN_1305 | 4904 | CTCN_2985 | 10877 |
| GTCN_744 | 4862 | ATCN_2292 | 10835 | CTCN_1380 | 4905 | CTCN_2986 | 10878 |
| CTCN_1368 | 4863 | CTCN_2965 | 10836 | ATCN_916 | 4906 | CTCN_2987 | 10879 |
| TTCN_1291 | 4864 | GTCN_1669 | 10837 | TTCN_1306 | 4907 | TTCN_3366 | 10880 |
| CTCN_1369 | 4865 | GTCN_1670 | 10838 | CTCN_1381 | 4908 | TTCN_3367 | 10881 |
| CTCN_1370 | 4866 | GTCN_1671 | 10839 | ATCN_917 | 4909 | GTCN_1681 | 10882 |
| CTCN_1371 | 4867 | CTCN_2966 | 10840 | ATCN_918 | 4910 | GTCN_1682 | 10883 |
| ATCN_908 | 4868 | CTCN_2967 | 10841 | GTCN_752 | 4911 | CTCN_2988 | 10884 |
| TTCN_1292 | 4869 | CTCN_2968 | 10842 | CTCN_1382 | 4912 | CTCN_2989 | 10885 |
| ATCN_909 | 4870 | TTCN_3358 | 10843 | ATCN_919 | 4913 | TTCN_3368 | 10886 |
| TTCN_1293 | 4871 | CTCN_2969 | 10844 | ATCN_920 | 4914 | CTCN_2990 | 10887 |
| TTCN_1294 | 4872 | CTCN_2970 | 10845 | CTCN_1383 | 4915 | CTCN_2991 | 10888 |
| CTCN_1372 | 4873 | GTCN_1672 | 10846 | GTCN_753 | 4916 | CTCN_2992 | 10889 |
| TTCN_1295 | 4874 | ATCN_2293 | 10847 | ATCN_921 | 4917 | TTCN_3369 | 10890 |
| TTCN_1296 | 4875 | CTCN_2971 | 10848 | TTCN_1307 | 4918 | GTCN_1683 | 10891 |
| ATCN_910 | 4876 | CTCN_2972 | 10849 | GTCN_754 | 4919 | GTCN_1684 | 10892 |
| CTCN_1373 | 4877 | TTCN_3359 | 10850 | CTCN_1384 | 4920 | TTCN_3370 | 10893 |
| CTCN_1374 | 4878 | TTCN_3360 | 10851 | ATCN_922 | 4921 | CTCN_2993 | 10894 |
| CTCN_1375 | 4879 | CTCN_2973 | 10852 | CTCN_1385 | 4922 | GTCN_1685 | 10895 |
| GTCN_745 | 4880 | TTCN_3361 | 10853 | CTCN_1386 | 4923 | GTCN_1686 | 10896 |
| ATCN_911 | 4881 | GTCN_1673 | 10854 | CTCN_1387 | 4924 | CTCN_2994 | 10897 |
| TTCN_1297 | 4882 | CTCN_2974 | 10855 | TTCN_1308 | 4925 | CTCN_2995 | 10898 |
| TTCN_1298 | 4883 | CTCN_2975 | 10856 | TTCN_1309 | 4926 | TTCN_3371 | 10899 |
| ATCN_912 | 4884 | CTCN_2976 | 10857 | CTCN_1388 | 4927 | CTCN_2996 | 10900 |
| CTCN_1376 | 4885 | CTCN_2977 | 10858 | CTCN_1389 | 4928 | GTCN_1687 | 10901 |
| TTCN_1299 | 4886 | CTCN_2978 | 10859 | CTCN_1390 | 4929 | CTCN_2997 | 10902 |
| TTCN_1300 | 4887 | GTCN_1674 | 10860 | CTCN_1391 | 4930 | CTCN_2998 | 10903 |
| CTCN_1377 | 4888 | TTCN_3362 | 10861 | ATCN_923 | 4931 | GTCN_1688 | 10904 |
| GTCN_746 | 4889 | CTCN_2979 | 10862 | ATCN_924 | 4932 | CTCN_2999 | 10905 |
| TTCN_1301 | 4890 | TTCN_3363 | 10863 | CTCN_1392 | 4933 | TTCN_3372 | 10906 |

FIG. 33 (continued)

| | | | | | | | |
|---|---|---|---|---|---|---|---|
| GTCN_755 | 4934 | CTCN_3000 | 10907 | ATCN_937 | 4977 | GTCN_1697 | 10950 |
| CTCN_1393 | 4935 | TTCN_3373 | 10908 | TTCN_1321 | 4978 | GTCN_1698 | 10951 |
| CTCN_1394 | 4936 | CTCN_3001 | 10909 | ATCN_938 | 4979 | GTCN_1699 | 10952 |
| GTCN_756 | 4937 | CTCN_3002 | 10910 | CTCN_1403 | 4980 | TTCN_3379 | 10953 |
| CTCN_1395 | 4938 | CTCN_3003 | 10911 | CTCN_1404 | 4981 | CTCN_3027 | 10954 |
| GTCN_757 | 4939 | CTCN_3004 | 10912 | TTCN_1322 | 4982 | GTCN_1700 | 10955 |
| ATCN_925 | 4940 | CTCN_3005 | 10913 | CTCN_1405 | 4983 | CTCN_3028 | 10956 |
| TTCN_1310 | 4941 | CTCN_3006 | 10914 | GTCN_765 | 4984 | ATCN_2296 | 10957 |
| ATCN_926 | 4942 | CTCN_3007 | 10915 | CTCN_1406 | 4985 | ATCN_2297 | 10958 |
| GTCN_758 | 4943 | GTCN_1689 | 10916 | CTCN_1407 | 4986 | CTCN_3029 | 10959 |
| CTCN_1396 | 4944 | TTCN_3374 | 10917 | CTCN_1408 | 4987 | GTCN_1701 | 10960 |
| CTCN_1397 | 4945 | ATCN_2294 | 10918 | CTCN_1409 | 4988 | CTCN_3030 | 10961 |
| TTCN_1311 | 4946 | CTCN_3008 | 10919 | ATCN_939 | 4989 | CTCN_3031 | 10962 |
| ATCN_927 | 4947 | TTCN_3375 | 10920 | ATCN_940 | 4990 | CTCN_3032 | 10963 |
| ATCN_928 | 4948 | CTCN_3009 | 10921 | CTCN_1410 | 4991 | GTCN_1702 | 10964 |
| CTCN_1398 | 4949 | GTCN_1690 | 10922 | CTCN_1411 | 4992 | CTCN_3033 | 10965 |
| ATCN_929 | 4950 | TTCN_3376 | 10923 | CTCN_1412 | 4993 | GTCN_1703 | 10966 |
| GTCN_759 | 4951 | GTCN_1691 | 10924 | CTCN_1413 | 4994 | CTCN_3034 | 10967 |
| ATCN_930 | 4952 | CTCN_3010 | 10925 | TTCN_1323 | 4995 | TTCN_3380 | 10968 |
| TTCN_1312 | 4953 | GTCN_1692 | 10926 | TTCN_1324 | 4996 | CTCN_3035 | 10969 |
| TTCN_1313 | 4954 | CTCN_3011 | 10927 | CTCN_1414 | 4997 | CTCN_3036 | 10970 |
| TTCN_1314 | 4955 | GTCN_1693 | 10928 | GTCN_766 | 4998 | CTCN_3037 | 10971 |
| ATCN_931 | 4956 | CTCN_3012 | 10929 | CTCN_1415 | 4999 | CTCN_3038 | 10972 |
| TTCN_1315 | 4957 | CTCN_3013 | 10930 | CTCN_1416 | 5000 | TTCN_3381 | 10973 |
| CTCN_1399 | 4958 | CTCN_3014 | 10931 | GTCN_767 | 5001 | ATCN_2298 | 10974 |
| CTCN_1400 | 4959 | CTCN_3015 | 10932 | CTCN_1417 | 5002 | CTCN_3039 | 10975 |
| ATCN_932 | 4960 | CTCN_3016 | 10933 | GTCN_768 | 5003 | CTCN_3040 | 10976 |
| ATCN_933 | 4961 | CTCN_3017 | 10934 | TTCN_1325 | 5004 | CTCN_3041 | 10977 |
| GTCN_760 | 4962 | CTCN_3018 | 10935 | GTCN_769 | 5005 | CTCN_3042 | 10978 |
| ATCN_934 | 4963 | CTCN_3019 | 10936 | CTCN_1418 | 5006 | CTCN_3043 | 10979 |
| TTCN_1316 | 4964 | CTCN_3020 | 10937 | CTCN_1419 | 5007 | TTCN_3382 | 10980 |
| GTCN_761 | 4965 | CTCN_3021 | 10938 | TTCN_1326 | 5008 | TTCN_3383 | 10981 |
| TTCN_1317 | 4966 | ATCN_2295 | 10939 | ATCN_941 | 5009 | TTCN_3384 | 10982 |
| GTCN_762 | 4967 | CTCN_3022 | 10940 | ATCN_942 | 5010 | GTCN_1704 | 10983 |
| TTCN_1318 | 4968 | GTCN_1694 | 10941 | GTCN_770 | 5011 | TTCN_3385 | 10984 |
| GTCN_763 | 4969 | GTCN_1695 | 10942 | CTCN_1420 | 5012 | CTCN_3044 | 10985 |
| CTCN_1401 | 4970 | CTCN_3023 | 10943 | CTCN_1421 | 5013 | TTCN_3386 | 10986 |
| TTCN_1319 | 4971 | CTCN_3024 | 10944 | ATCN_943 | 5014 | CTCN_3045 | 10987 |
| ATCN_935 | 4972 | TTCN_3377 | 10945 | TTCN_1327 | 5015 | TTCN_3387 | 10988 |
| CTCN_1402 | 4973 | TTCN_3378 | 10946 | TTCN_1328 | 5016 | GTCN_1705 | 10989 |
| ATCN_936 | 4974 | GTCN_1696 | 10947 | TTCN_1329 | 5017 | TTCN_3388 | 10990 |
| TTCN_1320 | 4975 | CTCN_3025 | 10948 | TTCN_1330 | 5018 | ATCN_2299 | 10991 |
| GTCN_764 | 4976 | CTCN_3026 | 10949 | TTCN_1331 | 5019 | ATCN_2300 | 10992 |

FIG. 33 (continued)

| | | | | | | | |
|---|---|---|---|---|---|---|---|
| TTCN_1332 | 5020 | TTCN_3389 | 10993 | CTCN_1432 | 5063 | CTCN_3063 | 11036 |
| ATCN_944 | 5021 | CTCN_3046 | 10994 | TTCN_1344 | 5064 | GTCN_1712 | 11037 |
| ATCN_945 | 5022 | CTCN_3047 | 10995 | TTCN_1345 | 5065 | ATCN_2310 | 11038 |
| GTCN_771 | 5023 | CTCN_3048 | 10996 | TTCN_1346 | 5066 | CTCN_3064 | 11039 |
| ATCN_946 | 5024 | ATCN_2301 | 10997 | ATCN_958 | 5067 | TTCN_3400 | 11040 |
| GTCN_772 | 5025 | TTCN_3390 | 10998 | CTCN_1433 | 5068 | CTCN_3065 | 11041 |
| TTCN_1333 | 5026 | TTCN_3391 | 10999 | CTCN_1434 | 5069 | GTCN_1713 | 11042 |
| CTCN_1422 | 5027 | ATCN_2302 | 11000 | ATCN_959 | 5070 | CTCN_3066 | 11043 |
| CTCN_1423 | 5028 | TTCN_3392 | 11001 | CTCN_1435 | 5071 | CTCN_3067 | 11044 |
| TTCN_1334 | 5029 | CTCN_3049 | 11002 | CTCN_1436 | 5072 | CTCN_3068 | 11045 |
| ATCN_947 | 5030 | TTCN_3393 | 11003 | ATCN_960 | 5073 | GTCN_1714 | 11046 |
| ATCN_948 | 5031 | CTCN_3050 | 11004 | CTCN_1437 | 5074 | CTCN_3069 | 11047 |
| CTCN_1424 | 5032 | ATCN_2303 | 11005 | CTCN_1438 | 5075 | CTCN_3070 | 11048 |
| TTCN_1335 | 5033 | ATCN_2304 | 11006 | TTCN_1347 | 5076 | CTCN_3071 | 11049 |
| ATCN_949 | 5034 | TTCN_3394 | 11007 | CTCN_1439 | 5077 | CTCN_3072 | 11050 |
| CTCN_1425 | 5035 | CTCN_3051 | 11008 | CTCN_1440 | 5078 | CTCN_3073 | 11051 |
| ATCN_950 | 5036 | GTCN_1706 | 11009 | GTCN_778 | 5079 | CTCN_3074 | 11052 |
| TTCN_1336 | 5037 | CTCN_3052 | 11010 | ATCN_961 | 5080 | GTCN_1715 | 11053 |
| ATCN_951 | 5038 | GTCN_1707 | 11011 | CTCN_1441 | 5081 | CTCN_3075 | 11054 |
| ATCN_952 | 5039 | TTCN_3395 | 11012 | CTCN_1442 | 5082 | CTCN_3076 | 11055 |
| CTCN_1426 | 5040 | ATCN_2305 | 11013 | GTCN_779 | 5083 | TTCN_3401 | 11056 |
| GTCN_773 | 5041 | TTCN_3396 | 11014 | CTCN_1443 | 5084 | CTCN_3077 | 11057 |
| CTCN_1427 | 5042 | CTCN_3053 | 11015 | CTCN_1444 | 5085 | ATCN_2311 | 11058 |
| GTCN_774 | 5043 | CTCN_3054 | 11016 | GTCN_780 | 5086 | CTCN_3078 | 11059 |
| TTCN_1337 | 5044 | GTCN_1708 | 11017 | GTCN_781 | 5087 | CTCN_3079 | 11060 |
| TTCN_1338 | 5045 | GTCN_1709 | 11018 | CTCN_1445 | 5088 | TTCN_3402 | 11061 |
| TTCN_1339 | 5046 | CTCN_3055 | 11019 | CTCN_1446 | 5089 | TTCN_3403 | 11062 |
| CTCN_1428 | 5047 | ATCN_2306 | 11020 | CTCN_1447 | 5090 | CTCN_3080 | 11063 |
| ATCN_953 | 5048 | TTCN_3397 | 11021 | CTCN_1448 | 5091 | ATCN_2312 | 11064 |
| ATCN_954 | 5049 | CTCN_3056 | 11022 | CTCN_1449 | 5092 | ATCN_2313 | 11065 |
| CTCN_1429 | 5050 | TTCN_3398 | 11023 | CTCN_1450 | 5093 | TTCN_3404 | 11066 |
| ATCN_955 | 5051 | ATCN_2307 | 11024 | CTCN_1451 | 5094 | CTCN_3081 | 11067 |
| GTCN_775 | 5052 | CTCN_3057 | 11025 | CTCN_1452 | 5095 | CTCN_3082 | 11068 |
| TTCN_1340 | 5053 | GTCN_1710 | 11026 | CTCN_1453 | 5096 | TTCN_3405 | 11069 |
| TTCN_1341 | 5054 | TTCN_3399 | 11027 | CTCN_1454 | 5097 | ATCN_2314 | 11070 |
| TTCN_1342 | 5055 | GTCN_1711 | 11028 | CTCN_1455 | 5098 | CTCN_3083 | 11071 |
| ATCN_956 | 5056 | ATCN_2308 | 11029 | TTCN_1348 | 5099 | CTCN_3084 | 11072 |
| GTCN_776 | 5057 | CTCN_3058 | 11030 | CTCN_1456 | 5100 | GTCN_1716 | 11073 |
| ATCN_957 | 5058 | CTCN_3059 | 11031 | TTCN_1349 | 5101 | TTCN_3406 | 11074 |
| TTCN_1343 | 5059 | CTCN_3060 | 11032 | CTCN_1457 | 5102 | TTCN_3407 | 11075 |
| GTCN_777 | 5060 | CTCN_3061 | 11033 | CTCN_1458 | 5103 | GTCN_1717 | 11076 |
| CTCN_1430 | 5061 | CTCN_3062 | 11034 | CTCN_1459 | 5104 | TTCN_3408 | 11077 |
| CTCN_1431 | 5062 | ATCN_2309 | 11035 | CTCN_1460 | 5105 | CTCN_3085 | 11078 |

FIG. 33 (continued)

| | | | | | | | |
|---|---|---|---|---|---|---|---|
| CTCN_1461 | 5106 | TTCN_3409 | 11079 | TTCN_1353 | 5149 | GTCN_1727 | 11122 |
| CTCN_1462 | 5107 | ATCN_2315 | 11080 | GTCN_789 | 5150 | ATCN_2321 | 11123 |
| CTCN_1463 | 5108 | CTCN_3086 | 11081 | ATCN_966 | 5151 | ATCN_2322 | 11124 |
| CTCN_1464 | 5109 | TTCN_3410 | 11082 | ATCN_967 | 5152 | TTCN_3423 | 11125 |
| TTCN_1350 | 5110 | TTCN_3411 | 11083 | GTCN_790 | 5153 | CTCN_3100 | 11126 |
| TTCN_1351 | 5111 | TTCN_3412 | 11084 | CTCN_1490 | 5154 | CTCN_3101 | 11127 |
| CTCN_1465 | 5112 | ATCN_2316 | 11085 | TTCN_1354 | 5155 | GTCN_1728 | 11128 |
| CTCN_1466 | 5113 | TTCN_3413 | 11086 | TTCN_1355 | 5156 | CTCN_3102 | 11129 |
| CTCN_1467 | 5114 | CTCN_3087 | 11087 | ATCN_968 | 5157 | ATCN_2323 | 11130 |
| CTCN_1468 | 5115 | TTCN_3414 | 11088 | GTCN_791 | 5158 | GTCN_1729 | 11131 |
| CTCN_1469 | 5116 | CTCN_3088 | 11089 | CTCN_1491 | 5159 | CTCN_3103 | 11132 |
| CTCN_1470 | 5117 | CTCN_3089 | 11090 | ATCN_969 | 5160 | CTCN_3104 | 11133 |
| CTCN_1471 | 5118 | CTCN_3090 | 11091 | CTCN_1492 | 5161 | GTCN_1730 | 11134 |
| CTCN_1472 | 5119 | GTCN_1718 | 11092 | CTCN_1493 | 5162 | CTCN_3105 | 11135 |
| CTCN_1473 | 5120 | CTCN_3091 | 11093 | CTCN_1494 | 5163 | ATCN_2324 | 11136 |
| ATCN_962 | 5121 | ATCN_2317 | 11094 | TTCN_1356 | 5164 | CTCN_3106 | 11137 |
| TTCN_1352 | 5122 | GTCN_1719 | 11095 | GTCN_792 | 5165 | ATCN_2325 | 11138 |
| CTCN_1474 | 5123 | ATCN_2318 | 11096 | CTCN_1495 | 5166 | ATCN_2326 | 11139 |
| CTCN_1475 | 5124 | TTCN_3415 | 11097 | ATCN_970 | 5167 | TTCN_3424 | 11140 |
| CTCN_1476 | 5125 | GTCN_1720 | 11098 | ATCN_971 | 5168 | ATCN_2327 | 11141 |
| GTCN_782 | 5126 | CTCN_3092 | 11099 | GTCN_793 | 5169 | CTCN_3107 | 11142 |
| CTCN_1477 | 5127 | GTCN_1721 | 11100 | GTCN_794 | 5170 | GTCN_1731 | 11143 |
| CTCN_1478 | 5128 | ATCN_2319 | 11101 | CTCN_1496 | 5171 | TTCN_3425 | 11144 |
| CTCN_1479 | 5129 | TTCN_3416 | 11102 | CTCN_1497 | 5172 | CTCN_3108 | 11145 |
| CTCN_1480 | 5130 | TTCN_3417 | 11103 | ATCN_972 | 5173 | TTCN_3426 | 11146 |
| CTCN_1481 | 5131 | CTCN_3093 | 11104 | ATCN_973 | 5174 | ATCN_2328 | 11147 |
| CTCN_1482 | 5132 | TTCN_3418 | 11105 | ATCN_974 | 5175 | TTCN_3427 | 11148 |
| GTCN_783 | 5133 | GTCN_1722 | 11106 | TTCN_1357 | 5176 | TTCN_3428 | 11149 |
| CTCN_1483 | 5134 | TTCN_3419 | 11107 | CTCN_1498 | 5177 | ATCN_2329 | 11150 |
| GTCN_784 | 5135 | ATCN_2320 | 11108 | GTCN_795 | 5178 | CTCN_3109 | 11151 |
| ATCN_963 | 5136 | GTCN_1723 | 11109 | TTCN_1358 | 5179 | TTCN_3429 | 11152 |
| GTCN_785 | 5137 | GTCN_1724 | 11110 | TTCN_1359 | 5180 | CTCN_3110 | 11153 |
| GTCN_786 | 5138 | GTCN_1725 | 11111 | GTCN_796 | 5181 | TTCN_3430 | 11154 |
| CTCN_1484 | 5139 | TTCN_3420 | 11112 | TTCN_1360 | 5182 | CTCN_3111 | 11155 |
| CTCN_1485 | 5140 | CTCN_3094 | 11113 | ATCN_975 | 5183 | CTCN_3112 | 11156 |
| CTCN_1486 | 5141 | CTCN_3095 | 11114 | CTCN_1499 | 5184 | CTCN_3113 | 11157 |
| CTCN_1487 | 5142 | TTCN_3421 | 11115 | CTCN_1500 | 5185 | CTCN_3114 | 11158 |
| ATCN_964 | 5143 | CTCN_3096 | 11116 | GTCN_797 | 5186 | TTCN_3431 | 11159 |
| ATCN_965 | 5144 | GTCN_1726 | 11117 | CTCN_1501 | 5187 | ATCN_2330 | 11160 |
| GTCN_787 | 5145 | CTCN_3097 | 11118 | CTCN_1502 | 5188 | ATCN_2331 | 11161 |
| CTCN_1488 | 5146 | TTCN_3422 | 11119 | TTCN_1361 | 5189 | CTCN_3115 | 11162 |
| CTCN_1489 | 5147 | CTCN_3098 | 11120 | GTCN_798 | 5190 | GTCN_1732 | 11163 |
| GTCN_788 | 5148 | CTCN_3099 | 11121 | TTCN_1362 | 5191 | CTCN_3116 | 11164 |

FIG. 33 (continued)

| | | | | | | | |
|---|---|---|---|---|---|---|---|
| TTCN_1363 | 5192 | TTCN_3432 | 11165 | CTCN_1516 | 5235 | TTCN_3444 | 11208 |
| CTCN_1503 | 5193 | GTCN_1733 | 11166 | CTCN_1517 | 5236 | CTCN_3133 | 11209 |
| GTCN_799 | 5194 | ATCN_2332 | 11167 | CTCN_1518 | 5237 | ATCN_2339 | 11210 |
| TTCN_1364 | 5195 | TTCN_3433 | 11168 | ATCN_978 | 5238 | ATCN_2340 | 11211 |
| CTCN_1504 | 5196 | TTCN_3434 | 11169 | ATCN_979 | 5239 | GTCN_1741 | 11212 |
| TTCN_1365 | 5197 | GTCN_1734 | 11170 | TTCN_1382 | 5240 | TTCN_3445 | 11213 |
| TTCN_1366 | 5198 | CTCN_3117 | 11171 | ATCN_980 | 5241 | GTCN_1742 | 11214 |
| CTCN_1505 | 5199 | GTCN_1735 | 11172 | TTCN_1383 | 5242 | ATCN_2341 | 11215 |
| GTCN_800 | 5200 | CTCN_3118 | 11173 | GTCN_808 | 5243 | GTCN_1743 | 11216 |
| CTCN_1506 | 5201 | GTCN_1736 | 11174 | CTCN_1519 | 5244 | TTCN_3446 | 11217 |
| CTCN_1507 | 5202 | ATCN_2333 | 11175 | CTCN_1520 | 5245 | ATCN_2342 | 11218 |
| TTCN_1367 | 5203 | ATCN_2334 | 11176 | CTCN_1521 | 5246 | CTCN_3134 | 11219 |
| GTCN_801 | 5204 | CTCN_3119 | 11177 | ATCN_981 | 5247 | ATCN_2343 | 11220 |
| TTCN_1368 | 5205 | TTCN_3435 | 11178 | ATCN_982 | 5248 | TTCN_3447 | 11221 |
| CTCN_1508 | 5206 | CTCN_3120 | 11179 | CTCN_1522 | 5249 | TTCN_3448 | 11222 |
| CTCN_1509 | 5207 | TTCN_3436 | 11180 | CTCN_1523 | 5250 | ATCN_2344 | 11223 |
| CTCN_1510 | 5208 | TTCN_3437 | 11181 | GTCN_809 | 5251 | TTCN_3449 | 11224 |
| GTCN_802 | 5209 | TTCN_3438 | 11182 | CTCN_1524 | 5252 | ATCN_2345 | 11225 |
| TTCN_1369 | 5210 | TTCN_3439 | 11183 | CTCN_1525 | 5253 | ATCN_2346 | 11226 |
| TTCN_1370 | 5211 | GTCN_1737 | 11184 | ATCN_983 | 5254 | GTCN_1744 | 11227 |
| TTCN_1371 | 5212 | TTCN_3440 | 11185 | ATCN_984 | 5255 | CTCN_3135 | 11228 |
| CTCN_1511 | 5213 | CTCN_3121 | 11186 | GTCN_810 | 5256 | GTCN_1745 | 11229 |
| TTCN_1372 | 5214 | TTCN_3441 | 11187 | TTCN_1384 | 5257 | TTCN_3450 | 11230 |
| ATCN_976 | 5215 | CTCN_3122 | 11188 | TTCN_1385 | 5258 | TTCN_3451 | 11231 |
| TTCN_1373 | 5216 | CTCN_3123 | 11189 | TTCN_1386 | 5259 | TTCN_3452 | 11232 |
| ATCN_977 | 5217 | CTCN_3124 | 11190 | TTCN_1387 | 5260 | GTCN_1746 | 11233 |
| TTCN_1374 | 5218 | ATCN_2335 | 11191 | CTCN_1526 | 5261 | CTCN_3136 | 11234 |
| TTCN_1375 | 5219 | CTCN_3125 | 11192 | ATCN_985 | 5262 | GTCN_1747 | 11235 |
| CTCN_1512 | 5220 | CTCN_3126 | 11193 | CTCN_1527 | 5263 | CTCN_3137 | 11236 |
| GTCN_803 | 5221 | CTCN_3127 | 11194 | GTCN_811 | 5264 | GTCN_1748 | 11237 |
| TTCN_1376 | 5222 | GTCN_1738 | 11195 | GTCN_812 | 5265 | CTCN_3138 | 11238 |
| CTCN_1513 | 5223 | ATCN_2336 | 11196 | TTCN_1388 | 5266 | TTCN_3453 | 11239 |
| CTCN_1514 | 5224 | GTCN_1739 | 11197 | ATCN_986 | 5267 | TTCN_3454 | 11240 |
| GTCN_804 | 5225 | TTCN_3442 | 11198 | ATCN_987 | 5268 | GTCN_1749 | 11241 |
| TTCN_1377 | 5226 | GTCN_1740 | 11199 | CTCN_1528 | 5269 | ATCN_2347 | 11242 |
| TTCN_1378 | 5227 | CTCN_3128 | 11200 | GTCN_813 | 5270 | ATCN_2348 | 11243 |
| TTCN_1379 | 5228 | CTCN_3129 | 11201 | ATCN_988 | 5271 | GTCN_1750 | 11244 |
| GTCN_805 | 5229 | CTCN_3130 | 11202 | CTCN_1529 | 5272 | ATCN_2349 | 11245 |
| CTCN_1515 | 5230 | CTCN_3131 | 11203 | ATCN_989 | 5273 | TTCN_3455 | 11246 |
| GTCN_806 | 5231 | ATCN_2337 | 11204 | ATCN_990 | 5274 | TTCN_3456 | 11247 |
| TTCN_1380 | 5232 | ATCN_2338 | 11205 | TTCN_1389 | 5275 | TTCN_3457 | 11248 |
| TTCN_1381 | 5233 | CTCN_3132 | 11206 | TTCN_1390 | 5276 | ATCN_2350 | 11249 |
| GTCN_807 | 5234 | TTCN_3443 | 11207 | TTCN_1391 | 5277 | TTCN_3458 | 11250 |

FIG. 33 (continued)

| | | | | | | | |
|---|---|---|---|---|---|---|---|
| TTCN_1392 | 5278 | TTCN_3459 | 11251 | TTCN_1403 | 5321 | CTCN_3149 | 11294 |
| ATCN_991 | 5279 | TTCN_3460 | 11252 | CTCN_1547 | 5322 | CTCN_3150 | 11295 |
| GTCN_814 | 5280 | TTCN_3461 | 11253 | CTCN_1548 | 5323 | CTCN_3151 | 11296 |
| TTCN_1393 | 5281 | TTCN_3462 | 11254 | CTCN_1549 | 5324 | TTCN_3483 | 11297 |
| GTCN_815 | 5282 | TTCN_3463 | 11255 | GTCN_823 | 5325 | ATCN_2357 | 11298 |
| TTCN_1394 | 5283 | ATCN_2351 | 11256 | TTCN_1404 | 5326 | CTCN_3152 | 11299 |
| TTCN_1395 | 5284 | GTCN_1751 | 11257 | GTCN_824 | 5327 | GTCN_1754 | 11300 |
| TTCN_1396 | 5285 | TTCN_3464 | 11258 | TTCN_1405 | 5328 | GTCN_1755 | 11301 |
| TTCN_1397 | 5286 | TTCN_3465 | 11259 | CTCN_1550 | 5329 | TTCN_3484 | 11302 |
| CTCN_1530 | 5287 | TTCN_3466 | 11260 | ATCN_997 | 5330 | GTCN_1756 | 11303 |
| CTCN_1531 | 5288 | TTCN_3467 | 11261 | TTCN_1406 | 5331 | GTCN_1757 | 11304 |
| CTCN_1532 | 5289 | TTCN_3468 | 11262 | ATCN_998 | 5332 | TTCN_3485 | 11305 |
| CTCN_1533 | 5290 | TTCN_3469 | 11263 | TTCN_1407 | 5333 | CTCN_3153 | 11306 |
| GTCN_816 | 5291 | CTCN_3139 | 11264 | ATCN_999 | 5334 | TTCN_3486 | 11307 |
| TTCN_1398 | 5292 | TTCN_3470 | 11265 | ATCN_1000 | 5335 | ATCN_2358 | 11308 |
| ATCN_992 | 5293 | TTCN_3471 | 11266 | CTCN_1551 | 5336 | CTCN_3154 | 11309 |
| ATCN_993 | 5294 | TTCN_3472 | 11267 | TTCN_1408 | 5337 | CTCN_3155 | 11310 |
| CTCN_1534 | 5295 | ATCN_2352 | 11268 | GTCN_825 | 5338 | CTCN_3156 | 11311 |
| TTCN_1399 | 5296 | CTCN_3140 | 11269 | CTCN_1552 | 5339 | TTCN_3487 | 11312 |
| TTCN_1400 | 5297 | TTCN_3473 | 11270 | TTCN_1409 | 5340 | TTCN_3488 | 11313 |
| ATCN_994 | 5298 | CTCN_3141 | 11271 | ATCN_1001 | 5341 | CTCN_3157 | 11314 |
| CTCN_1535 | 5299 | CTCN_3142 | 11272 | TTCN_1410 | 5342 | TTCN_3489 | 11315 |
| ATCN_995 | 5300 | TTCN_3474 | 11273 | ATCN_1002 | 5343 | CTCN_3158 | 11316 |
| GTCN_817 | 5301 | ATCN_2353 | 11274 | TTCN_1411 | 5344 | TTCN_3490 | 11317 |
| CTCN_1536 | 5302 | CTCN_3143 | 11275 | ATCN_1003 | 5345 | TTCN_3491 | 11318 |
| CTCN_1537 | 5303 | TTCN_3475 | 11276 | ATCN_1004 | 5346 | CTCN_3159 | 11319 |
| CTCN_1538 | 5304 | CTCN_3144 | 11277 | ATCN_1005 | 5347 | CTCN_3160 | 11320 |
| CTCN_1539 | 5305 | GTCN_1752 | 11278 | CTCN_1553 | 5348 | CTCN_3161 | 11321 |
| GTCN_818 | 5306 | ATCN_2354 | 11279 | GTCN_826 | 5349 | GTCN_1758 | 11322 |
| CTCN_1540 | 5307 | TTCN_3476 | 11280 | CTCN_1554 | 5350 | TTCN_3492 | 11323 |
| ATCN_996 | 5308 | CTCN_3145 | 11281 | CTCN_1555 | 5351 | TTCN_3493 | 11324 |
| CTCN_1541 | 5309 | TTCN_3477 | 11282 | TTCN_1412 | 5352 | CTCN_3162 | 11325 |
| CTCN_1542 | 5310 | TTCN_3478 | 11283 | TTCN_1413 | 5353 | GTCN_1759 | 11326 |
| GTCN_819 | 5311 | TTCN_3479 | 11284 | GTCN_827 | 5354 | TTCN_3494 | 11327 |
| CTCN_1543 | 5312 | ATCN_2355 | 11285 | CTCN_1556 | 5355 | TTCN_3495 | 11328 |
| TTCN_1401 | 5313 | CTCN_3146 | 11286 | CTCN_1557 | 5356 | CTCN_3163 | 11329 |
| CTCN_1544 | 5314 | GTCN_1753 | 11287 | CTCN_1558 | 5357 | CTCN_3164 | 11330 |
| GTCN_820 | 5315 | TTCN_3480 | 11288 | TTCN_1414 | 5358 | ATCN_2359 | 11331 |
| TTCN_1402 | 5316 | CTCN_3147 | 11289 | CTCN_1559 | 5359 | TTCN_3496 | 11332 |
| GTCN_821 | 5317 | CTCN_3148 | 11290 | CTCN_1560 | 5360 | CTCN_3165 | 11333 |
| CTCN_1545 | 5318 | TTCN_3481 | 11291 | GTCN_828 | 5361 | CTCN_3166 | 11334 |
| GTCN_822 | 5319 | TTCN_3482 | 11292 | GTCN_829 | 5362 | TTCN_3497 | 11335 |
| CTCN_1546 | 5320 | ATCN_2356 | 11293 | CTCN_1561 | 5363 | TTCN_3498 | 11336 |

FIG. 33 (continued)

| | | | | | | | |
|---|---|---|---|---|---|---|---|
| GTCN_830 | 5364 | TTCN_3499 | 11337 | TTCN_1430 | 5407 | ATCN_2370 | 11380 |
| CTCN_1562 | 5365 | TTCN_3500 | 11338 | TTCN_1431 | 5408 | ATCN_2371 | 11381 |
| CTCN_1563 | 5366 | ATCN_2360 | 11339 | TTCN_1432 | 5409 | TTCN_3520 | 11382 |
| ATCN_1006 | 5367 | ATCN_2361 | 11340 | TTCN_1433 | 5410 | TTCN_3521 | 11383 |
| TTCN_1415 | 5368 | CTCN_3167 | 11341 | CTCN_1578 | 5411 | CTCN_3176 | 11384 |
| GTCN_831 | 5369 | ATCN_2362 | 11342 | TTCN_1434 | 5412 | CTCN_3177 | 11385 |
| CTCN_1564 | 5370 | GTCN_1760 | 11343 | TTCN_1435 | 5413 | TTCN_3522 | 11386 |
| GTCN_832 | 5371 | GTCN_1761 | 11344 | TTCN_1436 | 5414 | TTCN_3523 | 11387 |
| TTCN_1416 | 5372 | CTCN_3168 | 11345 | CTCN_1579 | 5415 | GTCN_1763 | 11388 |
| TTCN_1417 | 5373 | ATCN_2363 | 11346 | CTCN_1580 | 5416 | ATCN_2372 | 11389 |
| CTCN_1565 | 5374 | TTCN_3501 | 11347 | TTCN_1437 | 5417 | TTCN_3524 | 11390 |
| CTCN_1566 | 5375 | GTCN_1762 | 11348 | CTCN_1581 | 5418 | CTCN_3178 | 11391 |
| TTCN_1418 | 5376 | TTCN_3502 | 11349 | TTCN_1438 | 5419 | GTCN_1764 | 11392 |
| TTCN_1419 | 5377 | TTCN_3503 | 11350 | TTCN_1439 | 5420 | TTCN_3525 | 11393 |
| GTCN_833 | 5378 | TTCN_3504 | 11351 | CTCN_1582 | 5421 | TTCN_3526 | 11394 |
| GTCN_834 | 5379 | CTCN_3169 | 11352 | TTCN_1440 | 5422 | TTCN_3527 | 11395 |
| ATCN_1007 | 5380 | TTCN_3505 | 11353 | CTCN_1583 | 5423 | TTCN_3528 | 11396 |
| ATCN_1008 | 5381 | TTCN_3506 | 11354 | CTCN_1584 | 5424 | ATCN_2373 | 11397 |
| ATCN_1009 | 5382 | CTCN_3170 | 11355 | CTCN_1585 | 5425 | ATCN_2374 | 11398 |
| ATCN_1010 | 5383 | CTCN_3171 | 11356 | CTCN_1586 | 5426 | ATCN_2375 | 11399 |
| TTCN_1420 | 5384 | ATCN_2364 | 11357 | CTCN_1587 | 5427 | TTCN_3529 | 11400 |
| CTCN_1567 | 5385 | TTCN_3507 | 11358 | TTCN_1441 | 5428 | TTCN_3530 | 11401 |
| CTCN_1568 | 5386 | TTCN_3508 | 11359 | TTCN_1442 | 5429 | GTCN_1765 | 11402 |
| TTCN_1421 | 5387 | TTCN_3509 | 11360 | TTCN_1443 | 5430 | TTCN_3531 | 11403 |
| GTCN_835 | 5388 | TTCN_3510 | 11361 | GTCN_837 | 5431 | ATCN_2376 | 11404 |
| TTCN_1422 | 5389 | TTCN_3511 | 11362 | TTCN_1444 | 5432 | ATCN_2377 | 11405 |
| GTCN_836 | 5390 | CTCN_3172 | 11363 | TTCN_1445 | 5433 | TTCN_3532 | 11406 |
| TTCN_1423 | 5391 | CTCN_3173 | 11364 | TTCN_1446 | 5434 | TTCN_3533 | 11407 |
| CTCN_1569 | 5392 | TTCN_3512 | 11365 | GTCN_838 | 5435 | CTCN_3179 | 11408 |
| CTCN_1570 | 5393 | CTCN_3174 | 11366 | CTCN_1588 | 5436 | CTCN_3180 | 11409 |
| TTCN_1424 | 5394 | TTCN_3513 | 11367 | CTCN_1589 | 5437 | TTCN_3534 | 11410 |
| CTCN_1571 | 5395 | ATCN_2365 | 11368 | ATCN_1011 | 5438 | TTCN_3535 | 11411 |
| TTCN_1425 | 5396 | TTCN_3514 | 11369 | ATCN_1012 | 5439 | GTCN_1766 | 11412 |
| TTCN_1426 | 5397 | ATCN_2366 | 11370 | TTCN_1447 | 5440 | CTCN_3181 | 11413 |
| CTCN_1572 | 5398 | ATCN_2367 | 11371 | ATCN_1013 | 5441 | GTCN_1767 | 11414 |
| TTCN_1427 | 5399 | TTCN_3515 | 11372 | CTCN_1590 | 5442 | ATCN_2378 | 11415 |
| CTCN_1573 | 5400 | ATCN_2368 | 11373 | ATCN_1014 | 5443 | ATCN_2379 | 11416 |
| CTCN_1574 | 5401 | ATCN_2369 | 11374 | ATCN_1015 | 5444 | TTCN_3536 | 11417 |
| TTCN_1428 | 5402 | TTCN_3516 | 11375 | ATCN_1016 | 5445 | ATCN_2380 | 11418 |
| TTCN_1429 | 5403 | CTCN_3175 | 11376 | ATCN_1017 | 5446 | ATCN_2381 | 11419 |
| CTCN_1575 | 5404 | TTCN_3517 | 11377 | ATCN_1018 | 5447 | TTCN_3537 | 11420 |
| CTCN_1576 | 5405 | TTCN_3518 | 11378 | CTCN_1591 | 5448 | TTCN_3538 | 11421 |
| CTCN_1577 | 5406 | TTCN_3519 | 11379 | GTCN_839 | 5449 | ATCN_2382 | 11422 |

FIG. 33 (continued)

| | | | | | | | |
|---|---|---|---|---|---|---|---|
| ATCN_1019 | 5450 | ATCN_2383 | 11423 | GTCN_845 | 5493 | ATCN_2392 | 11466 |
| TTCN_1448 | 5451 | TTCN_3539 | 11424 | TTCN_1465 | 5494 | TTCN_3560 | 11467 |
| TTCN_1449 | 5452 | ATCN_2384 | 11425 | ATCN_1027 | 5495 | ATCN_2393 | 11468 |
| CTCN_1592 | 5453 | TTCN_3540 | 11426 | ATCN_1028 | 5496 | TTCN_3561 | 11469 |
| ATCN_1020 | 5454 | GTCN_1768 | 11427 | CTCN_1605 | 5497 | GTCN_1773 | 11470 |
| ATCN_1021 | 5455 | GTCN_1769 | 11428 | CTCN_1606 | 5498 | CTCN_3190 | 11471 |
| CTCN_1593 | 5456 | TTCN_3541 | 11429 | TTCN_1466 | 5499 | TTCN_3562 | 11472 |
| CTCN_1594 | 5457 | TTCN_3542 | 11430 | TTCN_1467 | 5500 | TTCN_3563 | 11473 |
| CTCN_1595 | 5458 | TTCN_3543 | 11431 | ATCN_1029 | 5501 | TTCN_3564 | 11474 |
| ATCN_1022 | 5459 | CTCN_3182 | 11432 | ATCN_1030 | 5502 | TTCN_3565 | 11475 |
| ATCN_1023 | 5460 | GTCN_1770 | 11433 | CTCN_1607 | 5503 | GTCN_1774 | 11476 |
| CTCN_1596 | 5461 | CTCN_3183 | 11434 | TTCN_1468 | 5504 | CTCN_3191 | 11477 |
| CTCN_1597 | 5462 | TTCN_3544 | 11435 | TTCN_1469 | 5505 | CTCN_3192 | 11478 |
| CTCN_1598 | 5463 | TTCN_3545 | 11436 | CTCN_1608 | 5506 | CTCN_3193 | 11479 |
| GTCN_840 | 5464 | GTCN_1771 | 11437 | ATCN_1031 | 5507 | ATCN_2394 | 11480 |
| ATCN_1024 | 5465 | CTCN_3184 | 11438 | CTCN_1609 | 5508 | ATCN_2395 | 11481 |
| TTCN_1450 | 5466 | CTCN_3185 | 11439 | CTCN_1610 | 5509 | GTCN_1775 | 11482 |
| TTCN_1451 | 5467 | ATCN_2385 | 11440 | ATCN_1032 | 5510 | CTCN_3194 | 11483 |
| TTCN_1452 | 5468 | CTCN_3186 | 11441 | ATCN_1033 | 5511 | ATCN_2396 | 11484 |
| CTCN_1599 | 5469 | TTCN_3546 | 11442 | CTCN_1611 | 5512 | ATCN_2397 | 11485 |
| ATCN_1025 | 5470 | CTCN_3187 | 11443 | GTCN_846 | 5513 | TTCN_3566 | 11486 |
| ATCN_1026 | 5471 | TTCN_3547 | 11444 | CTCN_1612 | 5514 | CTCN_3195 | 11487 |
| GTCN_841 | 5472 | TTCN_3548 | 11445 | TTCN_1470 | 5515 | TTCN_3567 | 11488 |
| TTCN_1453 | 5473 | ATCN_2386 | 11446 | CTCN_1613 | 5516 | GTCN_1776 | 11489 |
| GTCN_842 | 5474 | TTCN_3549 | 11447 | GTCN_847 | 5517 | GTCN_1777 | 11490 |
| TTCN_1454 | 5475 | TTCN_3550 | 11448 | TTCN_1471 | 5518 | CTCN_3196 | 11491 |
| TTCN_1455 | 5476 | ATCN_2387 | 11449 | ATCN_1034 | 5519 | TTCN_3568 | 11492 |
| TTCN_1456 | 5477 | TTCN_3551 | 11450 | CTCN_1614 | 5520 | TTCN_3569 | 11493 |
| TTCN_1457 | 5478 | TTCN_3552 | 11451 | GTCN_848 | 5521 | CTCN_3197 | 11494 |
| GTCN_843 | 5479 | TTCN_3553 | 11452 | CTCN_1615 | 5522 | ATCN_2398 | 11495 |
| TTCN_1458 | 5480 | TTCN_3554 | 11453 | CTCN_1616 | 5523 | TTCN_3570 | 11496 |
| TTCN_1459 | 5481 | CTCN_3188 | 11454 | CTCN_1617 | 5524 | GTCN_1778 | 11497 |
| TTCN_1460 | 5482 | CTCN_3189 | 11455 | CTCN_1618 | 5525 | CTCN_3198 | 11498 |
| TTCN_1461 | 5483 | TTCN_3555 | 11456 | TTCN_1472 | 5526 | ATCN_2399 | 11499 |
| CTCN_1600 | 5484 | TTCN_3556 | 11457 | ATCN_1035 | 5527 | TTCN_3571 | 11500 |
| CTCN_1601 | 5485 | ATCN_2388 | 11458 | TTCN_1473 | 5528 | TTCN_3572 | 11501 |
| TTCN_1462 | 5486 | TTCN_3557 | 11459 | CTCN_1619 | 5529 | CTCN_3199 | 11502 |
| CTCN_1602 | 5487 | ATCN_2389 | 11460 | CTCN_1620 | 5530 | GTCN_1779 | 11503 |
| TTCN_1463 | 5488 | ATCN_2390 | 11461 | CTCN_1621 | 5531 | TTCN_3573 | 11504 |
| CTCN_1603 | 5489 | ATCN_2391 | 11462 | ATCN_1036 | 5532 | GTCN_1780 | 11505 |
| TTCN_1464 | 5490 | TTCN_3558 | 11463 | CTCN_1622 | 5533 | TTCN_3574 | 11506 |
| CTCN_1604 | 5491 | TTCN_3559 | 11464 | GTCN_849 | 5534 | GTCN_1781 | 11507 |
| GTCN_844 | 5492 | GTCN_1772 | 11465 | CTCN_1623 | 5535 | GTCN_1782 | 11508 |

FIG. 33 (continued)

| | | | | | | | |
|---|---|---|---|---|---|---|---|
| CTCN_1624 | 5536 | GTCN_1783 | 11509 | CTCN_1634 | 5579 | TTCN_3586 | 11552 |
| GTCN_850 | 5537 | TTCN_3575 | 11510 | CTCN_1635 | 5580 | TTCN_3587 | 11553 |
| CTCN_1625 | 5538 | GTCN_1784 | 11511 | ATCN_1050 | 5581 | TTCN_3588 | 11554 |
| ATCN_1037 | 5539 | TTCN_3576 | 11512 | ATCN_1051 | 5582 | ATCN_2406 | 11555 |
| ATCN_1038 | 5540 | GTCN_1785 | 11513 | TTCN_1488 | 5583 | TTCN_3589 | 11556 |
| TTCN_1474 | 5541 | CTCN_3200 | 11514 | CTCN_1636 | 5584 | TTCN_3590 | 11557 |
| CTCN_1626 | 5542 | TTCN_3577 | 11515 | GTCN_856 | 5585 | TTCN_3591 | 11558 |
| ATCN_1039 | 5543 | TTCN_3578 | 11516 | TTCN_1489 | 5586 | TTCN_3592 | 11559 |
| GTCN_851 | 5544 | GTCN_1786 | 11517 | GTCN_857 | 5587 | GTCN_1793 | 11560 |
| TTCN_1475 | 5545 | TTCN_3579 | 11518 | TTCN_1490 | 5588 | TTCN_3593 | 11561 |
| ATCN_1040 | 5546 | GTCN_1787 | 11519 | GTCN_858 | 5589 | TTCN_3594 | 11562 |
| CTCN_1627 | 5547 | GTCN_1788 | 11520 | GTCN_859 | 5590 | TTCN_3595 | 11563 |
| GTCN_852 | 5548 | CTCN_3201 | 11521 | ATCN_1052 | 5591 | GTCN_1794 | 11564 |
| ATCN_1041 | 5549 | TTCN_3580 | 11522 | TTCN_1491 | 5592 | GTCN_1795 | 11565 |
| CTCN_1628 | 5550 | ATCN_2400 | 11523 | ATCN_1053 | 5593 | TTCN_3596 | 11566 |
| ATCN_1042 | 5551 | CTCN_3202 | 11524 | GTCN_860 | 5594 | TTCN_3597 | 11567 |
| TTCN_1476 | 5552 | CTCN_3203 | 11525 | GTCN_861 | 5595 | TTCN_3598 | 11568 |
| TTCN_1477 | 5553 | CTCN_3204 | 11526 | CTCN_1637 | 5596 | TTCN_3599 | 11569 |
| ATCN_1043 | 5554 | CTCN_3205 | 11527 | TTCN_1492 | 5597 | TTCN_3600 | 11570 |
| GTCN_853 | 5555 | TTCN_3581 | 11528 | CTCN_1638 | 5598 | TTCN_3601 | 11571 |
| CTCN_1629 | 5556 | TTCN_3582 | 11529 | TTCN_1493 | 5599 | TTCN_3602 | 11572 |
| TTCN_1478 | 5557 | CTCN_3206 | 11530 | GTCN_862 | 5600 | CTCN_3216 | 11573 |
| GTCN_854 | 5558 | CTCN_3207 | 11531 | CTCN_1639 | 5601 | ATCN_2407 | 11574 |
| GTCN_855 | 5559 | CTCN_3208 | 11532 | CTCN_1640 | 5602 | CTCN_3217 | 11575 |
| TTCN_1479 | 5560 | CTCN_3209 | 11533 | CTCN_1641 | 5603 | CTCN_3218 | 11576 |
| ATCN_1044 | 5561 | ATCN_2401 | 11534 | GTCN_863 | 5604 | GTCN_1796 | 11577 |
| TTCN_1480 | 5562 | ATCN_2402 | 11535 | ATCN_1054 | 5605 | TTCN_3603 | 11578 |
| ATCN_1045 | 5563 | CTCN_3210 | 11536 | ATCN_1055 | 5606 | TTCN_3604 | 11579 |
| CTCN_1630 | 5564 | CTCN_3211 | 11537 | TTCN_1494 | 5607 | CTCN_3219 | 11580 |
| ATCN_1046 | 5565 | GTCN_1789 | 11538 | TTCN_1495 | 5608 | TTCN_3605 | 11581 |
| CTCN_1631 | 5566 | CTCN_3212 | 11539 | ATCN_1056 | 5609 | TTCN_3606 | 11582 |
| TTCN_1481 | 5567 | GTCN_1790 | 11540 | TTCN_1496 | 5610 | TTCN_3607 | 11583 |
| TTCN_1482 | 5568 | CTCN_3213 | 11541 | TTCN_1497 | 5611 | GTCN_1797 | 11584 |
| CTCN_1632 | 5569 | ATCN_2403 | 11542 | TTCN_1498 | 5612 | ATCN_2408 | 11585 |
| ATCN_1047 | 5570 | GTCN_1791 | 11543 | TTCN_1499 | 5613 | ATCN_2409 | 11586 |
| ATCN_1048 | 5571 | TTCN_3583 | 11544 | TTCN_1500 | 5614 | CTCN_3220 | 11587 |
| TTCN_1483 | 5572 | CTCN_3214 | 11545 | TTCN_1501 | 5615 | ATCN_2410 | 11588 |
| CTCN_1633 | 5573 | CTCN_3215 | 11546 | ATCN_1057 | 5616 | ATCN_2411 | 11589 |
| ATCN_1049 | 5574 | TTCN_3584 | 11547 | CTCN_1642 | 5617 | CTCN_3221 | 11590 |
| TTCN_1484 | 5575 | ATCN_2404 | 11548 | GTCN_864 | 5618 | TTCN_3608 | 11591 |
| TTCN_1485 | 5576 | ATCN_2405 | 11549 | TTCN_1502 | 5619 | ATCN_2412 | 11592 |
| TTCN_1486 | 5577 | TTCN_3585 | 11550 | CTCN_1643 | 5620 | GTCN_1798 | 11593 |
| TTCN_1487 | 5578 | GTCN_1792 | 11551 | ATCN_1058 | 5621 | ATCN_2413 | 11594 |

FIG. 33 (continued)

| | | | | | | | |
|---|---|---|---|---|---|---|---|
| ATCN_1059 | 5622 | CTCN_3222 | 11595 | CTCN_1662 | 5665 | CTCN_3231 | 11638 |
| TTCN_1503 | 5623 | CTCN_3223 | 11596 | CTCN_1663 | 5666 | GTCN_1807 | 11639 |
| TTCN_1504 | 5624 | GTCN_1799 | 11597 | ATCN_1069 | 5667 | GTCN_1808 | 11640 |
| CTCN_1644 | 5625 | TTCN_3609 | 11598 | CTCN_1664 | 5668 | TTCN_3629 | 11641 |
| ATCN_1060 | 5626 | TTCN_3610 | 11599 | GTCN_872 | 5669 | TTCN_3630 | 11642 |
| CTCN_1645 | 5627 | TTCN_3611 | 11600 | CTCN_1665 | 5670 | TTCN_3631 | 11643 |
| ATCN_1061 | 5628 | ATCN_2414 | 11601 | CTCN_1666 | 5671 | GTCN_1809 | 11644 |
| CTCN_1646 | 5629 | ATCN_2415 | 11602 | GTCN_873 | 5672 | GTCN_1810 | 11645 |
| GTCN_865 | 5630 | TTCN_3612 | 11603 | GTCN_874 | 5673 | TTCN_3632 | 11646 |
| CTCN_1647 | 5631 | TTCN_3613 | 11604 | CTCN_1667 | 5674 | TTCN_3633 | 11647 |
| GTCN_866 | 5632 | TTCN_3614 | 11605 | ATCN_1070 | 5675 | TTCN_3634 | 11648 |
| ATCN_1062 | 5633 | CTCN_3224 | 11606 | CTCN_1668 | 5676 | ATCN_2420 | 11649 |
| ATCN_1063 | 5634 | TTCN_3615 | 11607 | GTCN_875 | 5677 | CTCN_3232 | 11650 |
| CTCN_1648 | 5635 | TTCN_3616 | 11608 | TTCN_1511 | 5678 | TTCN_3635 | 11651 |
| CTCN_1649 | 5636 | TTCN_3617 | 11609 | CTCN_1669 | 5679 | TTCN_3636 | 11652 |
| TTCN_1505 | 5637 | GTCN_1800 | 11610 | TTCN_1512 | 5680 | CTCN_3233 | 11653 |
| TTCN_1506 | 5638 | TTCN_3618 | 11611 | TTCN_1513 | 5681 | CTCN_3234 | 11654 |
| TTCN_1507 | 5639 | GTCN_1801 | 11612 | TTCN_1514 | 5682 | ATCN_2421 | 11655 |
| GTCN_867 | 5640 | CTCN_3225 | 11613 | TTCN_1515 | 5683 | ATCN_2422 | 11656 |
| TTCN_1508 | 5641 | TTCN_3619 | 11614 | GTCN_876 | 5684 | GTCN_1811 | 11657 |
| GTCN_868 | 5642 | TTCN_3620 | 11615 | ATCN_1071 | 5685 | GTCN_1812 | 11658 |
| CTCN_1650 | 5643 | TTCN_3621 | 11616 | TTCN_1516 | 5686 | CTCN_3235 | 11659 |
| CTCN_1651 | 5644 | ATCN_2416 | 11617 | CTCN_1670 | 5687 | CTCN_3236 | 11660 |
| GTCN_869 | 5645 | GTCN_1802 | 11618 | ATCN_1072 | 5688 | TTCN_3637 | 11661 |
| CTCN_1652 | 5646 | ATCN_2417 | 11619 | TTCN_1517 | 5689 | CTCN_3237 | 11662 |
| GTCN_870 | 5647 | TTCN_3622 | 11620 | TTCN_1518 | 5690 | ATCN_2423 | 11663 |
| ATCN_1064 | 5648 | TTCN_3623 | 11621 | CTCN_1671 | 5691 | ATCN_2424 | 11664 |
| CTCN_1653 | 5649 | GTCN_1803 | 11622 | CTCN_1672 | 5692 | TTCN_3638 | 11665 |
| CTCN_1654 | 5650 | TTCN_3624 | 11623 | GTCN_877 | 5693 | CTCN_3238 | 11666 |
| ATCN_1065 | 5651 | CTCN_3226 | 11624 | ATCN_1073 | 5694 | TTCN_3639 | 11667 |
| CTCN_1655 | 5652 | TTCN_3625 | 11625 | TTCN_1519 | 5695 | GTCN_1813 | 11668 |
| CTCN_1656 | 5653 | CTCN_3227 | 11626 | ATCN_1074 | 5696 | CTCN_3239 | 11669 |
| CTCN_1657 | 5654 | ATCN_2418 | 11627 | TTCN_1520 | 5697 | GTCN_1814 | 11670 |
| TTCN_1509 | 5655 | GTCN_1804 | 11628 | TTCN_1521 | 5698 | CTCN_3240 | 11671 |
| ATCN_1066 | 5656 | GTCN_1805 | 11629 | TTCN_1522 | 5699 | GTCN_1815 | 11672 |
| ATCN_1067 | 5657 | CTCN_3228 | 11630 | TTCN_1523 | 5700 | GTCN_1816 | 11673 |
| GTCN_871 | 5658 | CTCN_3229 | 11631 | TTCN_1524 | 5701 | TTCN_3640 | 11674 |
| CTCN_1658 | 5659 | ATCN_2419 | 11632 | CTCN_1673 | 5702 | GTCN_1817 | 11675 |
| CTCN_1659 | 5660 | TTCN_3626 | 11633 | GTCN_878 | 5703 | TTCN_3641 | 11676 |
| CTCN_1660 | 5661 | TTCN_3627 | 11634 | TTCN_1525 | 5704 | TTCN_3642 | 11677 |
| ATCN_1068 | 5662 | TTCN_3628 | 11635 | TTCN_1526 | 5705 | CTCN_3241 | 11678 |
| TTCN_1510 | 5663 | GTCN_1806 | 11636 | TTCN_1527 | 5706 | TTCN_3643 | 11679 |
| CTCN_1661 | 5664 | CTCN_3230 | 11637 | GTCN_879 | 5707 | GTCN_1818 | 11680 |

FIG. 33 (continued)

| | | | | | | | |
|---|---|---|---|---|---|---|---|
| ATCN_1075 | 5708 | CTCN_3242 | 11681 | ATCN_1080 | 5751 | CTCN_3264 | 11724 |
| CTCN_1674 | 5709 | CTCN_3243 | 11682 | CTCN_1686 | 5752 | ATCN_2434 | 11725 |
| GTCN_880 | 5710 | ATCN_2425 | 11683 | CTCN_1687 | 5753 | ATCN_2435 | 11726 |
| TTCN_1528 | 5711 | CTCN_3244 | 11684 | CTCN_1688 | 5754 | CTCN_3265 | 11727 |
| CTCN_1675 | 5712 | TTCN_3644 | 11685 | GTCN_892 | 5755 | CTCN_3266 | 11728 |
| TTCN_1529 | 5713 | TTCN_3645 | 11686 | GTCN_893 | 5756 | GTCN_1824 | 11729 |
| GTCN_881 | 5714 | TTCN_3646 | 11687 | CTCN_1689 | 5757 | CTCN_3267 | 11730 |
| TTCN_1530 | 5715 | ATCN_2426 | 11688 | GTCN_894 | 5758 | TTCN_3651 | 11731 |
| ATCN_1076 | 5716 | TTCN_3647 | 11689 | GTCN_895 | 5759 | CTCN_3268 | 11732 |
| ATCN_1077 | 5717 | CTCN_3245 | 11690 | GTCN_896 | 5760 | CTCN_3269 | 11733 |
| GTCN_882 | 5718 | CTCN_3246 | 11691 | CTCN_1690 | 5761 | CTCN_3270 | 11734 |
| CTCN_1676 | 5719 | CTCN_3247 | 11692 | GTCN_897 | 5762 | ATCN_2436 | 11735 |
| CTCN_1677 | 5720 | GTCN_1819 | 11693 | TTCN_1542 | 5763 | TTCN_3652 | 11736 |
| GTCN_883 | 5721 | CTCN_3248 | 11694 | GTCN_898 | 5764 | GTCN_1825 | 11737 |
| CTCN_1678 | 5722 | ATCN_2427 | 11695 | CTCN_1691 | 5765 | TTCN_3653 | 11738 |
| GTCN_884 | 5723 | ATCN_2428 | 11696 | TTCN_1543 | 5766 | CTCN_3271 | 11739 |
| GTCN_885 | 5724 | CTCN_3249 | 11697 | GTCN_899 | 5767 | CTCN_3272 | 11740 |
| TTCN_1531 | 5725 | CTCN_3250 | 11698 | CTCN_1692 | 5768 | CTCN_3273 | 11741 |
| GTCN_886 | 5726 | CTCN_3251 | 11699 | CTCN_1693 | 5769 | CTCN_3274 | 11742 |
| GTCN_887 | 5727 | ATCN_2429 | 11700 | GTCN_900 | 5770 | TTCN_3654 | 11743 |
| TTCN_1532 | 5728 | CTCN_3252 | 11701 | TTCN_1544 | 5771 | CTCN_3275 | 11744 |
| ATCN_1078 | 5729 | CTCN_3253 | 11702 | TTCN_1545 | 5772 | GTCN_1826 | 11745 |
| TTCN_1533 | 5730 | ATCN_2430 | 11703 | GTCN_901 | 5773 | CTCN_3276 | 11746 |
| ATCN_1079 | 5731 | ATCN_2431 | 11704 | ATCN_1081 | 5774 | CTCN_3277 | 11747 |
| TTCN_1534 | 5732 | GTCN_1820 | 11705 | ATCN_1082 | 5775 | ATCN_2437 | 11748 |
| TTCN_1535 | 5733 | CTCN_3254 | 11706 | TTCN_1546 | 5776 | TTCN_3655 | 11749 |
| TTCN_1536 | 5734 | ATCN_2432 | 11707 | CTCN_1694 | 5777 | ATCN_2438 | 11750 |
| TTCN_1537 | 5735 | ATCN_2433 | 11708 | TTCN_1547 | 5778 | TTCN_3656 | 11751 |
| CTCN_1679 | 5736 | CTCN_3255 | 11709 | GTCN_902 | 5779 | CTCN_3278 | 11752 |
| TTCN_1538 | 5737 | GTCN_1821 | 11710 | CTCN_1695 | 5780 | GTCN_1827 | 11753 |
| TTCN_1539 | 5738 | TTCN_3648 | 11711 | CTCN_1696 | 5781 | GTCN_1828 | 11754 |
| GTCN_888 | 5739 | GTCN_1822 | 11712 | CTCN_1697 | 5782 | ATCN_2439 | 11755 |
| TTCN_1540 | 5740 | CTCN_3256 | 11713 | CTCN_1698 | 5783 | TTCN_3657 | 11756 |
| CTCN_1680 | 5741 | GTCN_1823 | 11714 | GTCN_903 | 5784 | ATCN_2440 | 11757 |
| GTCN_889 | 5742 | CTCN_3257 | 11715 | CTCN_1699 | 5785 | CTCN_3279 | 11758 |
| CTCN_1681 | 5743 | CTCN_3258 | 11716 | GTCN_904 | 5786 | TTCN_3658 | 11759 |
| GTCN_890 | 5744 | CTCN_3259 | 11717 | CTCN_1700 | 5787 | CTCN_3280 | 11760 |
| TTCN_1541 | 5745 | CTCN_3260 | 11718 | GTCN_905 | 5788 | TTCN_3659 | 11761 |
| CTCN_1682 | 5746 | TTCN_3649 | 11719 | GTCN_906 | 5789 | TTCN_3660 | 11762 |
| GTCN_891 | 5747 | TTCN_3650 | 11720 | GTCN_907 | 5790 | TTCN_3661 | 11763 |
| CTCN_1683 | 5748 | CTCN_3261 | 11721 | TTCN_1548 | 5791 | ATCN_2441 | 11764 |
| CTCN_1684 | 5749 | CTCN_3262 | 11722 | CTCN_1701 | 5792 | TTCN_3662 | 11765 |
| CTCN_1685 | 5750 | CTCN_3263 | 11723 | GTCN_908 | 5793 | TTCN_3663 | 11766 |

FIG. 33 (continued)

| | | | | | | | |
|---|---|---|---|---|---|---|---|
| GTCN_909 | 5794 | CTCN_3281 | 11767 | GTCN_922 | 5837 | TTCN_3676 | 11810 |
| CTCN_1702 | 5795 | ATCN_2442 | 11768 | ATCN_1086 | 5838 | GTCN_1838 | 11811 |
| CTCN_1703 | 5796 | GTCN_1829 | 11769 | CTCN_1719 | 5839 | CTCN_3290 | 11812 |
| CTCN_1704 | 5797 | CTCN_3282 | 11770 | TTCN_1559 | 5840 | ATCN_2455 | 11813 |
| ATCN_1083 | 5798 | GTCN_1830 | 11771 | TTCN_1560 | 5841 | ATCN_2456 | 11814 |
| CTCN_1705 | 5799 | CTCN_3283 | 11772 | GTCN_1720 | 5842 | CTCN_3291 | 11815 |
| CTCN_1706 | 5800 | TTCN_3664 | 11773 | GTCN_923 | 5843 | ATCN_2457 | 11816 |
| GTCN_910 | 5801 | GTCN_1831 | 11774 | TTCN_1561 | 5844 | ATCN_2458 | 11817 |
| GTCN_911 | 5802 | ATCN_2443 | 11775 | CTCN_1721 | 5845 | GTCN_1839 | 11818 |
| GTCN_912 | 5803 | GTCN_1832 | 11776 | CTCN_1722 | 5846 | TTCN_3677 | 11819 |
| CTCN_1707 | 5804 | ATCN_2444 | 11777 | CTCN_1723 | 5847 | ATCN_2459 | 11820 |
| CTCN_1708 | 5805 | TTCN_3665 | 11778 | CTCN_1724 | 5848 | TTCN_3678 | 11821 |
| GTCN_913 | 5806 | ATCN_2445 | 11779 | CTCN_1725 | 5849 | ATCN_2460 | 11822 |
| TTCN_1549 | 5807 | CTCN_3284 | 11780 | GTCN_924 | 5850 | CTCN_3292 | 11823 |
| CTCN_1709 | 5808 | TTCN_3666 | 11781 | ATCN_1087 | 5851 | TTCN_3679 | 11824 |
| TTCN_1550 | 5809 | TTCN_3667 | 11782 | CTCN_1726 | 5852 | CTCN_3293 | 11825 |
| CTCN_1710 | 5810 | GTCN_1833 | 11783 | ATCN_1088 | 5853 | CTCN_3294 | 11826 |
| GTCN_914 | 5811 | TTCN_3668 | 11784 | ATCN_1089 | 5854 | ATCN_2461 | 11827 |
| GTCN_915 | 5812 | ATCN_2446 | 11785 | TTCN_1562 | 5855 | ATCN_2462 | 11828 |
| CTCN_1711 | 5813 | CTCN_3285 | 11786 | ATCN_1090 | 5856 | TTCN_3680 | 11829 |
| ATCN_1084 | 5814 | TTCN_3669 | 11787 | ATCN_1091 | 5857 | TTCN_3681 | 11830 |
| GTCN_916 | 5815 | ATCN_2447 | 11788 | CTCN_1727 | 5858 | ATCN_2463 | 11831 |
| GTCN_917 | 5816 | ATCN_2448 | 11789 | CTCN_1728 | 5859 | CTCN_3295 | 11832 |
| TTCN_1551 | 5817 | TTCN_3670 | 11790 | GTCN_925 | 5860 | CTCN_3296 | 11833 |
| ATCN_1085 | 5818 | GTCN_1834 | 11791 | ATCN_1092 | 5861 | CTCN_3297 | 11834 |
| CTCN_1712 | 5819 | CTCN_3286 | 11792 | GTCN_926 | 5862 | ATCN_2464 | 11835 |
| CTCN_1713 | 5820 | GTCN_1835 | 11793 | CTCN_1729 | 5863 | GTCN_1840 | 11836 |
| TTCN_1552 | 5821 | ATCN_2449 | 11794 | TTCN_1563 | 5864 | CTCN_3298 | 11837 |
| TTCN_1553 | 5822 | CTCN_3287 | 11795 | TTCN_1564 | 5865 | TTCN_3682 | 11838 |
| CTCN_1714 | 5823 | ATCN_2450 | 11796 | ATCN_1093 | 5866 | CTCN_3299 | 11839 |
| GTCN_918 | 5824 | TTCN_3671 | 11797 | ATCN_1094 | 5867 | TTCN_3683 | 11840 |
| CTCN_1715 | 5825 | CTCN_3288 | 11798 | ATCN_1095 | 5868 | ATCN_2465 | 11841 |
| GTCN_919 | 5826 | TTCN_3672 | 11799 | CTCN_1730 | 5869 | ATCN_2466 | 11842 |
| TTCN_1554 | 5827 | TTCN_3673 | 11800 | TTCN_1565 | 5870 | TTCN_3684 | 11843 |
| CTCN_1716 | 5828 | GTCN_1836 | 11801 | GTCN_927 | 5871 | ATCN_2467 | 11844 |
| TTCN_1555 | 5829 | CTCN_3289 | 11802 | CTCN_1731 | 5872 | TTCN_3685 | 11845 |
| TTCN_1556 | 5830 | ATCN_2451 | 11803 | GTCN_928 | 5873 | TTCN_3686 | 11846 |
| CTCN_1717 | 5831 | ATCN_2452 | 11804 | CTCN_1732 | 5874 | CTCN_3300 | 11847 |
| GTCN_920 | 5832 | ATCN_2453 | 11805 | TTCN_1566 | 5875 | TTCN_3687 | 11848 |
| GTCN_921 | 5833 | GTCN_1837 | 11806 | TTCN_1567 | 5876 | TTCN_3688 | 11849 |
| TTCN_1557 | 5834 | TTCN_3674 | 11807 | TTCN_1568 | 5877 | TTCN_3689 | 11850 |
| CTCN_1718 | 5835 | TTCN_3675 | 11808 | GTCN_929 | 5878 | TTCN_3690 | 11851 |
| TTCN_1558 | 5836 | ATCN_2454 | 11809 | CTCN_1733 | 5879 | TTCN_3691 | 11852 |

FIG. 33 (continued)

| | | | | | | | |
|---|---|---|---|---|---|---|---|
| TTCN_1569 | 5880 | ATCN_2468 | 11853 | TTCN_1588 | 5923 | TTCN_3707 | 11896 |
| TTCN_1570 | 5881 | TTCN_3692 | 11854 | CTCN_1744 | 5924 | GTCN_1851 | 11897 |
| GTCN_930 | 5882 | TTCN_3693 | 11855 | CTCN_1745 | 5925 | TTCN_3708 | 11898 |
| CTCN_1734 | 5883 | GTCN_1841 | 11856 | ATCN_1101 | 5926 | TTCN_3709 | 11899 |
| TTCN_1571 | 5884 | TTCN_3694 | 11857 | CTCN_1746 | 5927 | CTCN_3308 | 11900 |
| TTCN_1572 | 5885 | TTCN_3695 | 11858 | TTCN_1589 | 5928 | CTCN_3309 | 11901 |
| CTCN_1735 | 5886 | CTCN_3301 | 11859 | GTCN_939 | 5929 | CTCN_3310 | 11902 |
| ATCN_1096 | 5887 | CTCN_3302 | 11860 | CTCN_1747 | 5930 | CTCN_3311 | 11903 |
| GTCN_931 | 5888 | ATCN_2469 | 11861 | ATCN_1102 | 5931 | CTCN_3312 | 11904 |
| CTCN_1736 | 5889 | GTCN_1842 | 11862 | TTCN_1590 | 5932 | CTCN_3313 | 11905 |
| GTCN_932 | 5890 | GTCN_1843 | 11863 | TTCN_1591 | 5933 | GTCN_1852 | 11906 |
| TTCN_1573 | 5891 | TTCN_3696 | 11864 | TTCN_1592 | 5934 | GTCN_1853 | 11907 |
| TTCN_1574 | 5892 | TTCN_3697 | 11865 | GTCN_940 | 5935 | CTCN_3314 | 11908 |
| GTCN_933 | 5893 | GTCN_1844 | 11866 | CTCN_1748 | 5936 | ATCN_2479 | 11909 |
| CTCN_1737 | 5894 | ATCN_2470 | 11867 | TTCN_1593 | 5937 | CTCN_3315 | 11910 |
| TTCN_1575 | 5895 | TTCN_3698 | 11868 | GTCN_941 | 5938 | TTCN_3710 | 11911 |
| TTCN_1576 | 5896 | GTCN_1845 | 11869 | GTCN_942 | 5939 | CTCN_3316 | 11912 |
| TTCN_1577 | 5897 | TTCN_3699 | 11870 | TTCN_1594 | 5940 | GTCN_1854 | 11913 |
| ATCN_1097 | 5898 | TTCN_3700 | 11871 | GTCN_943 | 5941 | GTCN_1855 | 11914 |
| TTCN_1578 | 5899 | TTCN_3701 | 11872 | CTCN_1749 | 5942 | TTCN_3711 | 11915 |
| ATCN_1098 | 5900 | ATCN_2471 | 11873 | TTCN_1595 | 5943 | GTCN_1856 | 11916 |
| GTCN_934 | 5901 | ATCN_2472 | 11874 | CTCN_1750 | 5944 | GTCN_1857 | 11917 |
| TTCN_1579 | 5902 | GTCN_1846 | 11875 | TTCN_1596 | 5945 | CTCN_3317 | 11918 |
| TTCN_1580 | 5903 | ATCN_2473 | 11876 | TTCN_1597 | 5946 | CTCN_3318 | 11919 |
| TTCN_1581 | 5904 | TTCN_3702 | 11877 | GTCN_944 | 5947 | CTCN_3319 | 11920 |
| TTCN_1582 | 5905 | CTCN_3303 | 11878 | GTCN_945 | 5948 | CTCN_3320 | 11921 |
| CTCN_1738 | 5906 | GTCN_1847 | 11879 | CTCN_1751 | 5949 | ATCN_2480 | 11922 |
| CTCN_1739 | 5907 | ATCN_2474 | 11880 | CTCN_1752 | 5950 | ATCN_2481 | 11923 |
| ATCN_1099 | 5908 | TTCN_3703 | 11881 | GTCN_946 | 5951 | CTCN_3321 | 11924 |
| CTCN_1740 | 5909 | CTCN_3304 | 11882 | CTCN_1753 | 5952 | GTCN_1858 | 11925 |
| TTCN_1583 | 5910 | GTCN_1848 | 11883 | ATCN_1103 | 5953 | GTCN_1859 | 11926 |
| TTCN_1584 | 5911 | TTCN_3704 | 11884 | ATCN_1104 | 5954 | CTCN_3322 | 11927 |
| CTCN_1741 | 5912 | ATCN_2475 | 11885 | CTCN_1754 | 5955 | ATCN_2482 | 11928 |
| ATCN_1100 | 5913 | GTCN_1849 | 11886 | CTCN_1755 | 5956 | TTCN_3712 | 11929 |
| TTCN_1585 | 5914 | TTCN_3705 | 11887 | CTCN_1756 | 5957 | TTCN_3713 | 11930 |
| GTCN_935 | 5915 | TTCN_3706 | 11888 | CTCN_1757 | 5958 | CTCN_3323 | 11931 |
| TTCN_1586 | 5916 | CTCN_3305 | 11889 | TTCN_1598 | 5959 | TTCN_3714 | 11932 |
| CTCN_1742 | 5917 | CTCN_3306 | 11890 | TTCN_1599 | 5960 | GTCN_1860 | 11933 |
| CTCN_1743 | 5918 | ATCN_2476 | 11891 | CTCN_1758 | 5961 | CTCN_3324 | 11934 |
| GTCN_936 | 5919 | CTCN_3307 | 11892 | CTCN_1759 | 5962 | TTCN_3715 | 11935 |
| TTCN_1587 | 5920 | ATCN_2477 | 11893 | CTCN_1760 | 5963 | CTCN_3325 | 11936 |
| GTCN_937 | 5921 | GTCN_1850 | 11894 | GTCN_947 | 5964 | CTCN_3326 | 11937 |
| GTCN_938 | 5922 | ATCN_2478 | 11895 | CTCN_1761 | 5965 | TTCN_3716 | 11938 |

FIG. 33 (continued)

| | | | | | | | |
|---|---|---|---|---|---|---|---|
| GTCN_948 | 5966 | CTCN_3327 | 11939 | ATCN_1115 | 6009 | CTCN_3340 | 11982 |
| TTCN_1600 | 5967 | CTCN_3328 | 11940 | ATCN_1116 | 6010 | TTCN_3734 | 11983 |
| ATCN_1105 | 5968 | CTCN_3329 | 11941 | TTCN_1614 | 6011 | CTCN_3341 | 11984 |
| GTCN_949 | 5969 | CTCN_3330 | 11942 | ATCN_1117 | 6012 | ATCN_2488 | 11985 |
| CTCN_1762 | 5970 | CTCN_3331 | 11943 | GTCN_954 | 6013 | GTCN_1869 | 11986 |
| ATCN_1106 | 5971 | CTCN_3332 | 11944 | CTCN_1775 | 6014 | TTCN_3735 | 11987 |
| ATCN_1107 | 5972 | GTCN_1861 | 11945 | ATCN_1118 | 6015 | TTCN_3736 | 11988 |
| GTCN_950 | 5973 | CTCN_3333 | 11946 | ATCN_1119 | 6016 | TTCN_3737 | 11989 |
| GTCN_951 | 5974 | GTCN_1862 | 11947 | TTCN_1615 | 6017 | TTCN_3738 | 11990 |
| ATCN_1108 | 5975 | CTCN_3334 | 11948 | TTCN_1616 | 6018 | ATCN_2489 | 11991 |
| ATCN_1109 | 5976 | TTCN_3717 | 11949 | ATCN_1120 | 6019 | GTCN_1870 | 11992 |
| CTCN_1763 | 5977 | TTCN_3718 | 11950 | TTCN_1617 | 6020 | GTCN_1871 | 11993 |
| CTCN_1764 | 5978 | TTCN_3719 | 11951 | TTCN_1618 | 6021 | CTCN_3342 | 11994 |
| ATCN_1110 | 5979 | ATCN_2483 | 11952 | CTCN_1776 | 6022 | CTCN_3343 | 11995 |
| CTCN_1765 | 5980 | TTCN_3720 | 11953 | TTCN_1619 | 6023 | CTCN_3344 | 11996 |
| TTCN_1601 | 5981 | ATCN_2484 | 11954 | TTCN_1620 | 6024 | ATCN_2490 | 11997 |
| GTCN_952 | 5982 | CTCN_3335 | 11955 | CTCN_1777 | 6025 | CTCN_3345 | 11998 |
| CTCN_1766 | 5983 | GTCN_1863 | 11956 | ATCN_1121 | 6026 | ATCN_2491 | 11999 |
| CTCN_1767 | 5984 | TTCN_3721 | 11957 | ATCN_1122 | 6027 | TTCN_3739 | 12000 |
| TTCN_1602 | 5985 | GTCN_1864 | 11958 | CTCN_1778 | 6028 | TTCN_3740 | 12001 |
| ATCN_1111 | 5986 | TTCN_3722 | 11959 | TTCN_1621 | 6029 | GTCN_1872 | 12002 |
| TTCN_1603 | 5987 | CTCN_3336 | 11960 | CTCN_1779 | 6030 | CTCN_3346 | 12003 |
| CTCN_1768 | 5988 | ATCN_2485 | 11961 | TTCN_1622 | 6031 | TTCN_3741 | 12004 |
| CTCN_1769 | 5989 | TTCN_3723 | 11962 | GTCN_955 | 6032 | CTCN_3347 | 12005 |
| TTCN_1604 | 5990 | GTCN_1865 | 11963 | TTCN_1623 | 6033 | ATCN_2492 | 12006 |
| ATCN_1112 | 5991 | ATCN_2486 | 11964 | TTCN_1624 | 6034 | GTCN_1873 | 12007 |
| TTCN_1605 | 5992 | TTCN_3724 | 11965 | TTCN_1625 | 6035 | GTCN_1874 | 12008 |
| TTCN_1606 | 5993 | TTCN_3725 | 11966 | TTCN_1626 | 6036 | TTCN_3742 | 12009 |
| TTCN_1607 | 5994 | CTCN_3337 | 11967 | TTCN_1627 | 6037 | TTCN_3743 | 12010 |
| CTCN_1770 | 5995 | TTCN_3726 | 11968 | GTCN_956 | 6038 | CTCN_3348 | 12011 |
| TTCN_1608 | 5996 | TTCN_3727 | 11969 | CTCN_1780 | 6039 | CTCN_3349 | 12012 |
| TTCN_1609 | 5997 | CTCN_3338 | 11970 | ATCN_1123 | 6040 | CTCN_3350 | 12013 |
| GTCN_953 | 5998 | TTCN_3728 | 11971 | GTCN_957 | 6041 | GTCN_1875 | 12014 |
| TTCN_1610 | 5999 | TTCN_3729 | 11972 | TTCN_1628 | 6042 | GTCN_1876 | 12015 |
| CTCN_1771 | 6000 | TTCN_3730 | 11973 | CTCN_1781 | 6043 | TTCN_3744 | 12016 |
| TTCN_1611 | 6001 | ATCN_2487 | 11974 | TTCN_1629 | 6044 | TTCN_3745 | 12017 |
| CTCN_1772 | 6002 | GTCN_1866 | 11975 | TTCN_1630 | 6045 | ATCN_2493 | 12018 |
| ATCN_1113 | 6003 | CTCN_3339 | 11976 | CTCN_1782 | 6046 | GTCN_1877 | 12019 |
| CTCN_1773 | 6004 | TTCN_3731 | 11977 | ATCN_1124 | 6047 | TTCN_3746 | 12020 |
| TTCN_1612 | 6005 | GTCN_1867 | 11978 | CTCN_1783 | 6048 | CTCN_3351 | 12021 |
| TTCN_1613 | 6006 | GTCN_1868 | 11979 | CTCN_1784 | 6049 | GTCN_1878 | 12022 |
| ATCN_1114 | 6007 | TTCN_3732 | 11980 | GTCN_958 | 6050 | CTCN_3352 | 12023 |
| CTCN_1774 | 6008 | TTCN_3733 | 11981 | TTCN_1631 | 6051 | GTCN_1879 | 12024 |

FIG. 33 (continued)

| | | | | | | | |
|---|---|---|---|---|---|---|---|
| CTCN_1785 | 6052 | CTCN_3353 | 12025 | TTCN_1649 | 6095 | ATCN_2502 | 12068 |
| TTCN_1632 | 6053 | ATCN_2494 | 12026 | ATCN_1134 | 6096 | GTCN_1891 | 12069 |
| TTCN_1633 | 6054 | ATCN_2495 | 12027 | GTCN_969 | 6097 | ATCN_2503 | 12070 |
| CTCN_1786 | 6055 | CTCN_3354 | 12028 | CTCN_1792 | 6098 | TTCN_3755 | 12071 |
| GTCN_959 | 6056 | CTCN_3355 | 12029 | CTCN_1793 | 6099 | CTCN_3369 | 12072 |
| ATCN_1125 | 6057 | GTCN_1880 | 12030 | TTCN_1650 | 6100 | ATCN_2504 | 12073 |
| GTCN_960 | 6058 | TTCN_3747 | 12031 | TTCN_1651 | 6101 | TTCN_3756 | 12074 |
| TTCN_1634 | 6059 | GTCN_1881 | 12032 | GTCN_970 | 6102 | CTCN_3370 | 12075 |
| TTCN_1635 | 6060 | CTCN_3356 | 12033 | ATCN_1135 | 6103 | TTCN_3757 | 12076 |
| ATCN_1126 | 6061 | TTCN_3748 | 12034 | ATCN_1136 | 6104 | TTCN_3758 | 12077 |
| TTCN_1636 | 6062 | ATCN_2496 | 12035 | CTCN_1794 | 6105 | ATCN_2505 | 12078 |
| CTCN_1787 | 6063 | GTCN_1882 | 12036 | CTCN_1795 | 6106 | GTCN_1892 | 12079 |
| ATCN_1127 | 6064 | CTCN_3357 | 12037 | GTCN_971 | 6107 | TTCN_3759 | 12080 |
| TTCN_1637 | 6065 | GTCN_1883 | 12038 | ATCN_1137 | 6108 | ATCN_2506 | 12081 |
| TTCN_1638 | 6066 | CTCN_3358 | 12039 | ATCN_1138 | 6109 | TTCN_3760 | 12082 |
| GTCN_961 | 6067 | TTCN_3749 | 12040 | CTCN_1796 | 6110 | TTCN_3761 | 12083 |
| ATCN_1128 | 6068 | TTCN_3750 | 12041 | GTCN_972 | 6111 | GTCN_1893 | 12084 |
| TTCN_1639 | 6069 | CTCN_3359 | 12042 | ATCN_1139 | 6112 | CTCN_3371 | 12085 |
| CTCN_1788 | 6070 | GTCN_1884 | 12043 | CTCN_1797 | 6113 | CTCN_3372 | 12086 |
| GTCN_962 | 6071 | CTCN_3360 | 12044 | GTCN_973 | 6114 | TTCN_3762 | 12087 |
| GTCN_963 | 6072 | GTCN_1885 | 12045 | ATCN_1140 | 6115 | ATCN_2507 | 12088 |
| GTCN_964 | 6073 | CTCN_3361 | 12046 | TTCN_1652 | 6116 | ATCN_2508 | 12089 |
| ATCN_1129 | 6074 | GTCN_1886 | 12047 | GTCN_974 | 6117 | ATCN_2509 | 12090 |
| GTCN_965 | 6075 | CTCN_3362 | 12048 | CTCN_1798 | 6118 | CTCN_3373 | 12091 |
| CTCN_1789 | 6076 | GTCN_1887 | 12049 | GTCN_975 | 6119 | ATCN_2510 | 12092 |
| ATCN_1130 | 6077 | ATCN_2497 | 12050 | CTCN_1799 | 6120 | TTCN_3763 | 12093 |
| ATCN_1131 | 6078 | CTCN_3363 | 12051 | CTCN_1800 | 6121 | CTCN_3374 | 12094 |
| TTCN_1640 | 6079 | GTCN_1888 | 12052 | CTCN_1801 | 6122 | ATCN_2511 | 12095 |
| ATCN_1132 | 6080 | ATCN_2498 | 12053 | CTCN_1802 | 6123 | TTCN_3764 | 12096 |
| TTCN_1641 | 6081 | CTCN_3364 | 12054 | TTCN_1653 | 6124 | CTCN_3375 | 12097 |
| CTCN_1790 | 6082 | GTCN_1889 | 12055 | TTCN_1654 | 6125 | GTCN_1894 | 12098 |
| GTCN_966 | 6083 | ATCN_2499 | 12056 | CTCN_1803 | 6126 | TTCN_3765 | 12099 |
| TTCN_1642 | 6084 | TTCN_3751 | 12057 | CTCN_1804 | 6127 | GTCN_1895 | 12100 |
| TTCN_1643 | 6085 | CTCN_3365 | 12058 | CTCN_1805 | 6128 | TTCN_3766 | 12101 |
| CTCN_1791 | 6086 | TTCN_3752 | 12059 | CTCN_1806 | 6129 | ATCN_2512 | 12102 |
| TTCN_1644 | 6087 | CTCN_3366 | 12060 | ATCN_1141 | 6130 | TTCN_3767 | 12103 |
| TTCN_1645 | 6088 | GTCN_1890 | 12061 | ATCN_1142 | 6131 | TTCN_3768 | 12104 |
| TTCN_1646 | 6089 | ATCN_2500 | 12062 | GTCN_976 | 6132 | TTCN_3769 | 12105 |
| ATCN_1133 | 6090 | ATCN_2501 | 12063 | CTCN_1807 | 6133 | GTCN_1896 | 12106 |
| TTCN_1647 | 6091 | TTCN_3753 | 12064 | GTCN_977 | 6134 | CTCN_3376 | 12107 |
| TTCN_1648 | 6092 | TTCN_3754 | 12065 | CTCN_1808 | 6135 | CTCN_3377 | 12108 |
| GTCN_967 | 6093 | CTCN_3367 | 12066 | CTCN_1809 | 6136 | ATCN_2513 | 12109 |
| GTCN_968 | 6094 | CTCN_3368 | 12067 | GTCN_978 | 6137 | ATCN_2514 | 12110 |

FIG. 33 (continued)

| | | | | | | | |
|---|---|---|---|---|---|---|---|
| CTCN_1810 | 6138 | ATCN_2515 | 12111 | CTCN_1832 | 6181 | ATCN_2525 | 12154 |
| GTCN_979 | 6139 | TTCN_3770 | 12112 | TTCN_1662 | 6182 | CTCN_3388 | 12155 |
| CTCN_1811 | 6140 | TTCN_3771 | 12113 | TTCN_1663 | 6183 | ATCN_2526 | 12156 |
| TTCN_1655 | 6141 | ATCN_2516 | 12114 | GTCN_989 | 6184 | TTCN_3785 | 12157 |
| ATCN_1143 | 6142 | TTCN_3772 | 12115 | TTCN_1664 | 6185 | GTCN_1905 | 12158 |
| GTCN_980 | 6143 | GTCN_1897 | 12116 | ATCN_1147 | 6186 | ATCN_2527 | 12159 |
| CTCN_1812 | 6144 | TTCN_3773 | 12117 | ATCN_1148 | 6187 | TTCN_3786 | 12160 |
| CTCN_1813 | 6145 | TTCN_3774 | 12118 | CTCN_1833 | 6188 | CTCN_3389 | 12161 |
| CTCN_1814 | 6146 | CTCN_3378 | 12119 | CTCN_1834 | 6189 | CTCN_3390 | 12162 |
| CTCN_1815 | 6147 | CTCN_3379 | 12120 | ATCN_1149 | 6190 | TTCN_3787 | 12163 |
| CTCN_1816 | 6148 | GTCN_1898 | 12121 | TTCN_1665 | 6191 | ATCN_2528 | 12164 |
| GTCN_981 | 6149 | ATCN_2517 | 12122 | CTCN_1835 | 6192 | TTCN_3788 | 12165 |
| GTCN_982 | 6150 | TTCN_3775 | 12123 | TTCN_1666 | 6193 | TTCN_3789 | 12166 |
| TTCN_1656 | 6151 | GTCN_1899 | 12124 | ATCN_1150 | 6194 | TTCN_3790 | 12167 |
| GTCN_983 | 6152 | TTCN_3776 | 12125 | ATCN_1151 | 6195 | GTCN_1906 | 12168 |
| TTCN_1657 | 6153 | CTCN_3380 | 12126 | CTCN_1836 | 6196 | TTCN_3791 | 12169 |
| GTCN_984 | 6154 | TTCN_3777 | 12127 | CTCN_1837 | 6197 | TTCN_3792 | 12170 |
| CTCN_1817 | 6155 | GTCN_1900 | 12128 | GTCN_990 | 6198 | ATCN_2529 | 12171 |
| TTCN_1658 | 6156 | ATCN_2518 | 12129 | CTCN_1838 | 6199 | TTCN_3793 | 12172 |
| CTCN_1818 | 6157 | CTCN_3381 | 12130 | CTCN_1839 | 6200 | TTCN_3794 | 12173 |
| TTCN_1659 | 6158 | CTCN_3382 | 12131 | TTCN_1667 | 6201 | ATCN_2530 | 12174 |
| CTCN_1819 | 6159 | ATCN_2519 | 12132 | TTCN_1668 | 6202 | TTCN_3795 | 12175 |
| CTCN_1820 | 6160 | ATCN_2520 | 12133 | GTCN_991 | 6203 | TTCN_3796 | 12176 |
| ATCN_1144 | 6161 | CTCN_3383 | 12134 | ATCN_1152 | 6204 | TTCN_3797 | 12177 |
| CTCN_1821 | 6162 | ATCN_2521 | 12135 | GTCN_992 | 6205 | TTCN_3798 | 12178 |
| GTCN_985 | 6163 | GTCN_1901 | 12136 | ATCN_1153 | 6206 | CTCN_3391 | 12179 |
| CTCN_1822 | 6164 | CTCN_3384 | 12137 | TTCN_1669 | 6207 | CTCN_3392 | 12180 |
| CTCN_1823 | 6165 | CTCN_3385 | 12138 | CTCN_1840 | 6208 | ATCN_2531 | 12181 |
| TTCN_1660 | 6166 | CTCN_3386 | 12139 | GTCN_993 | 6209 | GTCN_1907 | 12182 |
| TTCN_1661 | 6167 | GTCN_1902 | 12140 | TTCN_1670 | 6210 | TTCN_3799 | 12183 |
| CTCN_1824 | 6168 | TTCN_3778 | 12141 | CTCN_1841 | 6211 | TTCN_3800 | 12184 |
| CTCN_1825 | 6169 | TTCN_3779 | 12142 | ATCN_1154 | 6212 | ATCN_2532 | 12185 |
| CTCN_1826 | 6170 | GTCN_1903 | 12143 | TTCN_1671 | 6213 | CTCN_3393 | 12186 |
| CTCN_1827 | 6171 | TTCN_3780 | 12144 | TTCN_1672 | 6214 | TTCN_3801 | 12187 |
| ATCN_1145 | 6172 | GTCN_1904 | 12145 | TTCN_1673 | 6215 | TTCN_3802 | 12188 |
| ATCN_1146 | 6173 | CTCN_3387 | 12146 | CTCN_1842 | 6216 | GTCN_1908 | 12189 |
| CTCN_1828 | 6174 | ATCN_2522 | 12147 | CTCN_1843 | 6217 | TTCN_3803 | 12190 |
| GTCN_986 | 6175 | TTCN_3781 | 12148 | CTCN_1844 | 6218 | ATCN_2533 | 12191 |
| CTCN_1829 | 6176 | TTCN_3782 | 12149 | TTCN_1674 | 6219 | ATCN_2534 | 12192 |
| CTCN_1830 | 6177 | TTCN_3783 | 12150 | TTCN_1675 | 6220 | CTCN_3394 | 12193 |
| GTCN_987 | 6178 | ATCN_2523 | 12151 | GTCN_994 | 6221 | TTCN_3804 | 12194 |
| CTCN_1831 | 6179 | TTCN_3784 | 12152 | TTCN_1676 | 6222 | TTCN_3805 | 12195 |
| GTCN_988 | 6180 | ATCN_2524 | 12153 | TTCN_1677 | 6223 | TTCN_3806 | 12196 |

FIG. 33 (continued)

| | | | | | | | |
|---|---|---|---|---|---|---|---|
| GTCN_995 | 6224 | TTCN_3807 | 12197 | CTCN_1860 | 6267 | GTCN_1916 | 12240 |
| GTCN_996 | 6225 | TTCN_3808 | 12198 | ATCN_1164 | 6268 | CTCN_3409 | 12241 |
| TTCN_1678 | 6226 | CTCN_3395 | 12199 | CTCN_1861 | 6269 | CTCN_3410 | 12242 |
| ATCN_1155 | 6227 | GTCN_1909 | 12200 | TTCN_1686 | 6270 | TTCN_3819 | 12243 |
| TTCN_1679 | 6228 | TTCN_3809 | 12201 | CTCN_1862 | 6271 | ATCN_2545 | 12244 |
| TTCN_1680 | 6229 | TTCN_3810 | 12202 | TTCN_1687 | 6272 | CTCN_3411 | 12245 |
| CTCN_1845 | 6230 | ATCN_2535 | 12203 | CTCN_1863 | 6273 | TTCN_3820 | 12246 |
| CTCN_1846 | 6231 | GTCN_1910 | 12204 | GTCN_1006 | 6274 | CTCN_3412 | 12247 |
| ATCN_1156 | 6232 | CTCN_3396 | 12205 | TTCN_1688 | 6275 | ATCN_2546 | 12248 |
| GTCN_997 | 6233 | GTCN_1911 | 12206 | GTCN_1007 | 6276 | ATCN_2547 | 12249 |
| TTCN_1681 | 6234 | CTCN_3397 | 12207 | ATCN_1165 | 6277 | CTCN_3413 | 12250 |
| ATCN_1157 | 6235 | TTCN_3811 | 12208 | ATCN_1166 | 6278 | GTCN_1917 | 12251 |
| CTCN_1847 | 6236 | CTCN_3398 | 12209 | CTCN_1864 | 6279 | GTCN_1918 | 12252 |
| CTCN_1848 | 6237 | CTCN_3399 | 12210 | TTCN_1689 | 6280 | CTCN_3414 | 12253 |
| CTCN_1849 | 6238 | CTCN_3400 | 12211 | ATCN_1167 | 6281 | CTCN_3415 | 12254 |
| TTCN_1682 | 6239 | ATCN_2536 | 12212 | TTCN_1690 | 6282 | CTCN_3416 | 12255 |
| GTCN_998 | 6240 | GTCN_1912 | 12213 | GTCN_1008 | 6283 | CTCN_3417 | 12256 |
| CTCN_1850 | 6241 | GTCN_1913 | 12214 | GTCN_1009 | 6284 | ATCN_2548 | 12257 |
| GTCN_999 | 6242 | CTCN_3401 | 12215 | TTCN_1691 | 6285 | CTCN_3418 | 12258 |
| CTCN_1851 | 6243 | ATCN_2537 | 12216 | TTCN_1692 | 6286 | CTCN_3419 | 12259 |
| CTCN_1852 | 6244 | ATCN_2538 | 12217 | GTCN_1010 | 6287 | CTCN_3420 | 12260 |
| ATCN_1158 | 6245 | GTCN_1914 | 12218 | GTCN_1011 | 6288 | GTCN_1919 | 12261 |
| ATCN_1159 | 6246 | TTCN_3812 | 12219 | ATCN_1168 | 6289 | CTCN_3421 | 12262 |
| GTCN_1000 | 6247 | CTCN_3402 | 12220 | GTCN_1012 | 6290 | CTCN_3422 | 12263 |
| GTCN_1001 | 6248 | ATCN_2539 | 12221 | TTCN_1693 | 6291 | GTCN_1920 | 12264 |
| CTCN_1853 | 6249 | TTCN_3813 | 12222 | CTCN_1865 | 6292 | TTCN_3821 | 12265 |
| CTCN_1854 | 6250 | TTCN_3814 | 12223 | TTCN_1694 | 6293 | CTCN_3423 | 12266 |
| ATCN_1160 | 6251 | TTCN_3815 | 12224 | TTCN_1695 | 6294 | CTCN_3424 | 12267 |
| ATCN_1161 | 6252 | CTCN_3403 | 12225 | ATCN_1169 | 6295 | CTCN_3425 | 12268 |
| CTCN_1855 | 6253 | TTCN_3816 | 12226 | ATCN_1170 | 6296 | TTCN_3822 | 12269 |
| GTCN_1002 | 6254 | CTCN_3404 | 12227 | ATCN_1171 | 6297 | CTCN_3426 | 12270 |
| TTCN_1683 | 6255 | CTCN_3405 | 12228 | ATCN_1172 | 6298 | CTCN_3427 | 12271 |
| CTCN_1856 | 6256 | CTCN_3406 | 12229 | TTCN_1696 | 6299 | ATCN_2549 | 12272 |
| TTCN_1684 | 6257 | TTCN_3817 | 12230 | TTCN_1697 | 6300 | CTCN_3428 | 12273 |
| ATCN_1162 | 6258 | GTCN_1915 | 12231 | TTCN_1698 | 6301 | CTCN_3429 | 12274 |
| GTCN_1003 | 6259 | ATCN_2540 | 12232 | CTCN_1866 | 6302 | TTCN_3823 | 12275 |
| TTCN_1685 | 6260 | TTCN_3818 | 12233 | ATCN_1173 | 6303 | CTCN_3430 | 12276 |
| CTCN_1857 | 6261 | ATCN_2541 | 12234 | GTCN_1013 | 6304 | GTCN_1921 | 12277 |
| GTCN_1004 | 6262 | ATCN_2542 | 12235 | ATCN_1174 | 6305 | CTCN_3431 | 12278 |
| ATCN_1163 | 6263 | ATCN_2543 | 12236 | TTCN_1699 | 6306 | CTCN_3432 | 12279 |
| CTCN_1858 | 6264 | ATCN_2544 | 12237 | CTCN_1867 | 6307 | ATCN_2550 | 12280 |
| CTCN_1859 | 6265 | CTCN_3407 | 12238 | CTCN_1868 | 6308 | CTCN_3433 | 12281 |
| GTCN_1005 | 6266 | CTCN_3408 | 12239 | GTCN_1014 | 6309 | TTCN_3824 | 12282 |

FIG. 33 (continued)

| | | | | | | | |
|---|---|---|---|---|---|---|---|
| CTCN_1869 | 6310 | CTCN_3434 | 12283 | CTCN_1892 | 6353 | TTCN_3839 | 12326 |
| GTCN_1015 | 6311 | ATCN_2551 | 12284 | CTCN_1893 | 6354 | TTCN_3840 | 12327 |
| CTCN_1870 | 6312 | CTCN_3435 | 12285 | CTCN_1894 | 6355 | TTCN_3841 | 12328 |
| CTCN_1871 | 6313 | GTCN_1922 | 12286 | TTCN_1706 | 6356 | TTCN_3842 | 12329 |
| ATCN_1175 | 6314 | ATCN_2552 | 12287 | GTCN_1021 | 6357 | ATCN_2566 | 12330 |
| ATCN_1176 | 6315 | ATCN_2553 | 12288 | ATCN_1183 | 6358 | ATCN_2567 | 12331 |
| CTCN_1872 | 6316 | TTCN_3825 | 12289 | TTCN_1707 | 6359 | ATCN_2568 | 12332 |
| CTCN_1873 | 6317 | TTCN_3826 | 12290 | ATCN_1184 | 6360 | TTCN_3843 | 12333 |
| CTCN_1874 | 6318 | TTCN_3827 | 12291 | TTCN_1708 | 6361 | ATCN_2569 | 12334 |
| CTCN_1875 | 6319 | TTCN_3828 | 12292 | CTCN_1895 | 6362 | ATCN_2570 | 12335 |
| TTCN_1700 | 6320 | GTCN_1923 | 12293 | ATCN_1185 | 6363 | TTCN_3844 | 12336 |
| TTCN_1701 | 6321 | CTCN_3436 | 12294 | TTCN_1709 | 6364 | TTCN_3845 | 12337 |
| CTCN_1876 | 6322 | ATCN_2554 | 12295 | ATCN_1186 | 6365 | ATCN_2571 | 12338 |
| CTCN_1877 | 6323 | TTCN_3829 | 12296 | TTCN_1710 | 6366 | TTCN_3846 | 12339 |
| CTCN_1878 | 6324 | TTCN_3830 | 12297 | CTCN_1896 | 6367 | ATCN_2572 | 12340 |
| GTCN_1016 | 6325 | CTCN_3437 | 12298 | TTCN_1711 | 6368 | CTCN_3444 | 12341 |
| CTCN_1879 | 6326 | CTCN_3438 | 12299 | CTCN_1897 | 6369 | CTCN_3445 | 12342 |
| GTCN_1017 | 6327 | ATCN_2555 | 12300 | TTCN_1712 | 6370 | CTCN_3446 | 12343 |
| TTCN_1702 | 6328 | TTCN_3831 | 12301 | TTCN_1713 | 6371 | TTCN_3847 | 12344 |
| ATCN_1177 | 6329 | ATCN_2556 | 12302 | ATCN_1187 | 6372 | ATCN_2573 | 12345 |
| GTCN_1018 | 6330 | ATCN_2557 | 12303 | TTCN_1714 | 6373 | ATCN_2574 | 12346 |
| CTCN_1880 | 6331 | TTCN_3832 | 12304 | TTCN_1715 | 6374 | CTCN_3447 | 12347 |
| CTCN_1881 | 6332 | ATCN_2558 | 12305 | CTCN_1898 | 6375 | CTCN_3448 | 12348 |
| CTCN_1882 | 6333 | ATCN_2559 | 12306 | ATCN_1188 | 6376 | CTCN_3449 | 12349 |
| GTCN_1019 | 6334 | TTCN_3833 | 12307 | ATCN_1189 | 6377 | CTCN_3450 | 12350 |
| CTCN_1883 | 6335 | ATCN_2560 | 12308 | CTCN_1899 | 6378 | GTCN_1926 | 12351 |
| ATCN_1178 | 6336 | GTCN_1924 | 12309 | ATCN_1190 | 6379 | ATCN_2575 | 12352 |
| ATCN_1179 | 6337 | CTCN_3439 | 12310 | ATCN_1191 | 6380 | ATCN_2576 | 12353 |
| GTCN_1020 | 6338 | ATCN_2561 | 12311 | ATCN_1192 | 6381 | GTCN_1927 | 12354 |
| CTCN_1884 | 6339 | TTCN_3834 | 12312 | TTCN_1716 | 6382 | CTCN_3451 | 12355 |
| CTCN_1885 | 6340 | TTCN_3835 | 12313 | TTCN_1717 | 6383 | CTCN_3452 | 12356 |
| ATCN_1180 | 6341 | TTCN_3836 | 12314 | TTCN_1718 | 6384 | ATCN_2577 | 12357 |
| CTCN_1886 | 6342 | ATCN_2562 | 12315 | ATCN_1193 | 6385 | CTCN_3453 | 12358 |
| TTCN_1703 | 6343 | CTCN_3440 | 12316 | TTCN_1719 | 6386 | TTCN_3848 | 12359 |
| CTCN_1887 | 6344 | ATCN_2563 | 12317 | ATCN_1194 | 6387 | CTCN_3454 | 12360 |
| TTCN_1704 | 6345 | TTCN_3837 | 12318 | ATCN_1195 | 6388 | GTCN_1928 | 12361 |
| TTCN_1705 | 6346 | CTCN_3441 | 12319 | ATCN_1196 | 6389 | CTCN_3455 | 12362 |
| CTCN_1888 | 6347 | TTCN_3838 | 12320 | ATCN_1197 | 6390 | GTCN_1929 | 12363 |
| ATCN_1181 | 6348 | CTCN_3442 | 12321 | ATCN_1198 | 6391 | GTCN_1930 | 12364 |
| ATCN_1182 | 6349 | ATCN_2564 | 12322 | ATCN_1199 | 6392 | ATCN_2578 | 12365 |
| CTCN_1889 | 6350 | ATCN_2565 | 12323 | TTCN_1720 | 6393 | ATCN_2579 | 12366 |
| CTCN_1890 | 6351 | GTCN_1925 | 12324 | TTCN_1721 | 6394 | CTCN_3456 | 12367 |
| CTCN_1891 | 6352 | CTCN_3443 | 12325 | TTCN_1722 | 6395 | ATCN_2580 | 12368 |

FIG. 33 (continued)

| | | | | | | | |
|---|---|---|---|---|---|---|---|
| CTCN_1900 | 6396 | TTCN_3849 | 12369 | ATCN_1209 | 6439 | CTCN_3466 | 12412 |
| CTCN_1901 | 6397 | CTCN_3457 | 12370 | ATCN_1210 | 6440 | GTCN_1939 | 12413 |
| GTCN_1022 | 6398 | ATCN_2581 | 12371 | GTCN_1027 | 6441 | CTCN_3467 | 12414 |
| CTCN_1902 | 6399 | ATCN_2582 | 12372 | GTCN_1028 | 6442 | CTCN_3468 | 12415 |
| ATCN_1200 | 6400 | ATCN_2583 | 12373 | TTCN_1737 | 6443 | GTCN_1940 | 12416 |
| CTCN_1903 | 6401 | ATCN_2584 | 12374 | TTCN_1738 | 6444 | TTCN_3862 | 12417 |
| TTCN_1723 | 6402 | CTCN_3458 | 12375 | CTCN_1915 | 6445 | ATCN_2594 | 12418 |
| TTCN_1724 | 6403 | GTCN_1931 | 12376 | TTCN_1739 | 6446 | ATCN_2595 | 12419 |
| CTCN_1904 | 6404 | GTCN_1932 | 12377 | GTCN_1029 | 6447 | ATCN_2596 | 12420 |
| GTCN_1023 | 6405 | GTCN_1933 | 12378 | GTCN_1030 | 6448 | TTCN_3863 | 12421 |
| CTCN_1905 | 6406 | ATCN_2585 | 12379 | TTCN_1740 | 6449 | ATCN_2597 | 12422 |
| CTCN_1906 | 6407 | GTCN_1934 | 12380 | CTCN_1916 | 6450 | GTCN_1941 | 12423 |
| CTCN_1907 | 6408 | CTCN_3459 | 12381 | ATCN_1211 | 6451 | ATCN_2598 | 12424 |
| TTCN_1725 | 6409 | ATCN_2586 | 12382 | CTCN_1917 | 6452 | GTCN_1942 | 12425 |
| GTCN_1024 | 6410 | CTCN_3460 | 12383 | GTCN_1031 | 6453 | TTCN_3864 | 12426 |
| TTCN_1726 | 6411 | TTCN_3850 | 12384 | CTCN_1918 | 6454 | GTCN_1943 | 12427 |
| CTCN_1908 | 6412 | TTCN_3851 | 12385 | CTCN_1919 | 6455 | TTCN_3865 | 12428 |
| GTCN_1025 | 6413 | CTCN_3461 | 12386 | ATCN_1212 | 6456 | TTCN_3866 | 12429 |
| CTCN_1909 | 6414 | TTCN_3852 | 12387 | ATCN_1213 | 6457 | GTCN_1944 | 12430 |
| CTCN_1910 | 6415 | TTCN_3853 | 12388 | CTCN_1920 | 6458 | ATCN_2599 | 12431 |
| TTCN_1727 | 6416 | ATCN_2587 | 12389 | CTCN_1921 | 6459 | TTCN_3867 | 12432 |
| GTCN_1026 | 6417 | GTCN_1935 | 12390 | CTCN_1922 | 6460 | ATCN_2600 | 12433 |
| ATCN_1201 | 6418 | GTCN_1936 | 12391 | CTCN_1923 | 6461 | ATCN_2601 | 12434 |
| TTCN_1728 | 6419 | ATCN_2588 | 12392 | TTCN_1741 | 6462 | TTCN_3868 | 12435 |
| ATCN_1202 | 6420 | ATCN_2589 | 12393 | ATCN_1214 | 6463 | TTCN_3869 | 12436 |
| TTCN_1729 | 6421 | TTCN_3854 | 12394 | TTCN_1742 | 6464 | CTCN_3469 | 12437 |
| CTCN_1911 | 6422 | TTCN_3855 | 12395 | CTCN_1924 | 6465 | GTCN_1945 | 12438 |
| CTCN_1912 | 6423 | TTCN_3856 | 12396 | CTCN_1925 | 6466 | ATCN_2602 | 12439 |
| ATCN_1203 | 6424 | TTCN_3857 | 12397 | GTCN_1032 | 6467 | CTCN_3470 | 12440 |
| TTCN_1730 | 6425 | CTCN_3462 | 12398 | TTCN_1743 | 6468 | GTCN_1946 | 12441 |
| TTCN_1731 | 6426 | GTCN_1937 | 12399 | CTCN_1926 | 6469 | TTCN_3870 | 12442 |
| ATCN_1204 | 6427 | TTCN_3858 | 12400 | GTCN_1033 | 6470 | TTCN_3871 | 12443 |
| TTCN_1732 | 6428 | CTCN_3463 | 12401 | GTCN_1034 | 6471 | CTCN_3471 | 12444 |
| CTCN_1913 | 6429 | CTCN_3464 | 12402 | CTCN_1927 | 6472 | CTCN_3472 | 12445 |
| ATCN_1205 | 6430 | ATCN_2590 | 12403 | CTCN_1928 | 6473 | TTCN_3872 | 12446 |
| CTCN_1914 | 6431 | ATCN_2591 | 12404 | GTCN_1035 | 6474 | CTCN_3473 | 12447 |
| TTCN_1733 | 6432 | CTCN_3465 | 12405 | CTCN_1929 | 6475 | CTCN_3474 | 12448 |
| TTCN_1734 | 6433 | GTCN_1938 | 12406 | ATCN_1215 | 6476 | TTCN_3873 | 12449 |
| ATCN_1206 | 6434 | TTCN_3859 | 12407 | ATCN_1216 | 6477 | TTCN_3874 | 12450 |
| ATCN_1207 | 6435 | TTCN_3860 | 12408 | ATCN_1217 | 6478 | TTCN_3875 | 12451 |
| ATCN_1208 | 6436 | ATCN_2592 | 12409 | CTCN_1930 | 6479 | ATCN_2603 | 12452 |
| TTCN_1735 | 6437 | ATCN_2593 | 12410 | TTCN_1744 | 6480 | TTCN_3876 | 12453 |
| TTCN_1736 | 6438 | TTCN_3861 | 12411 | TTCN_1745 | 6481 | CTCN_3475 | 12454 |

FIG. 33 (continued)

| | | | | | | | |
|---|---|---|---|---|---|---|---|
| GTCN_1036 | 6482 | ATCN_2604 | 12455 | ATCN_1220 | 6504 | ATCN_2612 | 12477 |
| TTCN_1746 | 6483 | CTCN_3476 | 12456 | CTCN_1934 | 6505 | ATCN_2613 | 12478 |
| TTCN_1747 | 6484 | ATCN_2605 | 12457 | ATCN_1221 | 6506 | ATCN_2614 | 12479 |
| TTCN_1748 | 6485 | GTCN_1947 | 12458 | TTCN_1759 | 6507 | CTCN_3480 | 12480 |
| CTCN_1931 | 6486 | GTCN_1948 | 12459 | ATCN_1222 | 6508 | TTCN_3882 | 12481 |
| ATCN_1218 | 6487 | TTCN_3877 | 12460 | TTCN_1760 | 6509 | TTCN_3883 | 12482 |
| TTCN_1749 | 6488 | GTCN_1949 | 12461 | CTCN_1935 | 6510 | TTCN_3884 | 12483 |
| GTCN_1037 | 6489 | GTCN_1950 | 12462 | CTCN_1936 | 6511 | TTCN_3885 | 12484 |
| ATCN_1219 | 6490 | ATCN_2606 | 12463 | ATCN_1223 | 6512 | CTCN_3481 | 12485 |
| GTCN_1038 | 6491 | ATCN_2607 | 12464 | CTCN_1937 | 6513 | ATCN_2615 | 12486 |
| TTCN_1750 | 6492 | ATCN_2608 | 12465 | ATCN_1224 | 6514 | TTCN_3886 | 12487 |
| CTCN_1932 | 6493 | CTCN_3477 | 12466 | TTCN_1761 | 6515 | GTCN_1952 | 12488 |
| TTCN_1751 | 6494 | ATCN_2609 | 12467 | CTCN_1938 | 6516 | CTCN_3482 | 12489 |
| TTCN_1752 | 6495 | TTCN_3878 | 12468 | TTCN_1762 | 6517 | TTCN_3887 | 12490 |
| TTCN_1753 | 6496 | CTCN_3478 | 12469 | ATCN_1225 | 6518 | GTCN_1953 | 12491 |
| TTCN_1754 | 6497 | TTCN_3879 | 12470 | TTCN_1763 | 6519 | TTCN_3888 | 12492 |
| TTCN_1755 | 6498 | ATCN_2610 | 12471 | TTCN_1764 | 6520 | CTCN_3483 | 12493 |
| TTCN_1756 | 6499 | ATCN_2611 | 12472 | TTCN_1765 | 6521 | ATCN_2616 | 12494 |
| TTCN_1757 | 6500 | CTCN_3479 | 12473 | GTCN_1040 | 6522 | CTCN_3484 | 12495 |
| TTCN_1758 | 6501 | TTCN_3880 | 12474 | CTCN_1939 | 6523 | | |
| GTCN_1039 | 6502 | TTCN_3881 | 12475 | ATCN_1226 | 6524 | | |
| CTCN_1933 | 6503 | GTCN_1951 | 12476 | | | | |

COMPOSITIONS AND METHODS FOR THE TARGETING OF SOD1

CROSS REFERENCE TO RELATED APPLICATIONS

This application is a continuation of International Patent Application No. PCT/US2020/050000, filed on Sep. 9, 2020, which claims priority to U.S. Provisional Patent Application Nos. 62/897,941, filed on Sep. 9, 2019, 62/945,138, filed on Dec. 7, 2019 and 63/074,375, filed on Sep. 3, 2020, the contents of each of which are incorporated herein by reference in their entireties.

INCORPORATION BY REFERENCE OF SEQUENCE LISTING

The contents of the text file submitted electronically herewith are incorporated herein by reference in their entirety: A computer readable format copy of the Sequence Listing (filename: SCRB_009_03US_SeqList_ST25.txt, date recorded: Oct. 11, 2021, file size ~3.4 megabytes).

BACKGROUND

The wild-type SOD1 gene produces the enzyme SOD1 (superoxide dismutase 1; superoxide dismutase [Cu—Zn]), which is abundant in cells throughout the body. SOD1 binds copper and zinc ions and is one of three superoxide dismutases responsible for destroying free superoxide radicals in the body. At least 170 mutations across the SOD1 gene and its regulatory element have been found to cause amyotrophic lateral sclerosis (ALS; Lou Gehrig's disease) (Pochet, R. Genetics and ALS: Cause for Optimism. Cerebrum May 1; 2017. pii: cer-05-17), and with the exception of the recessive D90A mutation (Andersen et al., 1995, Nat Genet 10(1): 61-16), they are inherited in a highly penetrant autosomal dominant manner. Most pathogenic mutations are missense mutations, and nonsense and deletion mutations have only rarely been associated with disease (Fox, F. and Yamamoto A. Autophagy: Cancer, Other Pathologies, Inflammation, Immunity, Infection, and Aging. Volume 7: Role of Autophagy in Therapeutic Applications. 2015, Pages 117-137).

ALS is a neurodegenerative disease characterized by selective loss of motor neurons and is characterized by progressive muscle atrophy the inability to control movements. The pathology of ALS is characterized by abnormal accumulation of insoluble and misfolded proteins in degenerating motor neurons. Neuronal death results in progressive paralysis, which typically is fatal 2-5 years after the onset due to respiratory failure. Only about 5-10% of ALS cases are familial, with a Mendelian pattern of inheritance, and the remainder are of spontaneous, or "sporadic" origin. At least 13 genes and loci of major effect known to contribute to familial pathology. Of these, toxic gain-of-function mutations in the SOD1 gene have been most extensively investigated (Petrov, D. et al. ALS Clinical Trials Review: 20 Years of Failure. Are We Any Closer to Registering a New Treatment? Front Aging Neurosci. 9:68 (2017)). SOD1 mutations account for approximately 20% of cases of familial ALS and around 5% of idiopathic/sporadic forms of the disease (Kiernan, M. et al. Amyotrophic lateral sclerosis. Lancet 377:942 (2011)). The exact mechanisms whereby SOD1 contributes to disease progression are currently unknown. Examples of possible pathogenic mechanisms are the localization of mutant SOD1 to mitochondria resulting in caspase activation, formation of cytotoxic SOD1 aggregates that sequester other cellular proteins, perturbing their functions, and the selective inhibition of anterograde fast axonal transport resulting in depletion of mitochondria in axons (Stevens, J C et al. Modification of Superoxide Dismutase 1 (SOD1) Properties by a GFP Tag—Implications for Research into Amyotrophic Lateral Sclerosis (ALS). PLoS ONE 5(3): e9541 (2010).

With respect to ALS, virtually all known SOD1 mutations to date are dominant; a single mutant copy of the SOD1 gene is sufficient to cause ALS, for example. The mechanisms by which SOD1 mutations cause ALS and other SOD1-related disorders are unknown, but some are related to toxic gain of function (Sharma, A. et al. ALS-associated mutant FUS induces selective motor neuron degeneration through toxic gain of function. Nat Commun. 7:10465 (2016); Bunton-Stasyshyn R K et al. SOD1 Function and Its Implications for Amyotrophic Lateral Sclerosis Pathology: New and Renascent Themes. Neuroscientist. 21(5):519 (2015)). An additional cause of ALS is attributed to misfolded SOD1, in the form of small aggregates in the nuclei of glial cells (mostly astrocytes) of the spinal cord from ALS patients (Forsberg et al. Glial nuclear aggregates of superoxide dismutase-1 are regularly present in patients with amyotrophic lateral sclerosis. Acta Neuropathol. 121:623 (2011)).

Clinical trials with experimental therapeutics are difficult because of the complexity of the disease and its manifestations, making assessment of efficacy problematic. Clinical trial endpoints that have been utilized over the past 20 years include the ALS Functional Rating Scale (ALSFRS-(R)); combined assessment of function and survival; time to death, tracheostomy or persistent assisted ventilation (DTP); forced vital capacity (% FVC); manual muscle test; and maximum voluntary isometric contraction (Petrov, D. 2017).

The advent of CRISPR/Cas systems and the programmable nature of these minimal systems has facilitated their use as a versatile technology for genomic manipulation and engineering. Particular CRISPR proteins are particularly well suited for such manipulation. For example CasX, has compact size and ease of delivery, and the nucleotide sequence encoding the protein is relatively short; an advantage for its incorporation into viral vectors for delivery into a cell.

There remains a critical need for developing treatments for ALS and other SOD1-related disorders using such technologies. Provided herein are compositions and methods for targeting SOD1 to the address the same.

SUMMARY

In some aspects, the present disclosure provides CasX: guide nucleic acid systems (CasX:gNA system) and methods used to modify the superoxide dismutase 1 (SOD1) gene in a cell, the SOD1 gene comprising one or more mutations in the encoded SOD1 protein or in the SOD1 regulatory element. In some embodiments, the CasX:gNA system comprises a CasX protein and a guide nucleic acid (gNA), wherein the gNA comprises a targeting sequence complementary to a target nucleic acid sequence comprising a superoxide dismutase 1 (SOD1) gene.

In some embodiments, the disclosure provides CasX:gNA systems comprising a reference CasX or a CasX variant sequence comprising any one of SEQ ID NOS: 1-3 or a sequence of SEQ ID NOs: 36-131, 208, 210, 212, 214, 216-229, 240, 242, 244, 246, 248, 250, 252, 254, 256 or 258, or a sequence having at least about 50%, at least about 60%, at least about 70%, at least about 80%, or at least about 90%, or at least about 95%, or at least about 96%, or at least about 97%, or at least about 98%, or at least about 99% sequence identity thereto.

In some embodiments, the CasX:gNA systems comprises a guide nucleic acid (gNA), wherein the gNA comprises a targeting sequence complementary to a SOD1 gene target nucleic acid sequence. In some embodiments, the SOD1 gene comprises one or more mutations. In some embodiments, the gNA of the CasX:gNA system has a scaffold comprising a sequence of Tables 2A or 2B or a sequence having at least about 50%, at least about 60%, at least about 70%, at least about 80%, or at least about 90%, or at least about 95%, or at least about 96%, or at least about 97%, or at least about 98%, or at least about 99% sequence identity to a sequence of Tables 2A or 2B. In some embodiments, the CasX:gNA system gNA comprises a targeting sequence of Table 3 (Table 3 provides the gNA targeting sequences for the SOD1 gene; the table is provided in FIG. 33, and is referred to as Table 3 throughout), or a sequence having at least about 50%, at least about 60%, at least about 70%, at least about 80%, or at least about 85%, or at least about 90%, or at least about 95% sequence identity to a sequence of Table 3. In some embodiments, the CasX:gNA system further comprises a second gNA, wherein the second gNA has a targeting sequence complementary to a different or overlapping portion of the target nucleic acid.

In other embodiments of the CasX:gNA system, the CasX molecule and the gNA molecule are associated together in a ribonuclear protein complex (RNP).

In some embodiments, the present disclosure provides gene editing pairs comprising the CasX proteins and gNAs described herein.

In some embodiments, the CasX:gNA system further comprises a donor template comprising a nucleic acid; for example a donor template encoding at least a portion of a SOD1 gene selected from the group consisting of a SOD1 exon, a SOD1 intron, a SOD1 intron-exon junction, and a regulatory element.

In other embodiments, the disclosure provides nucleic acids encoding or comprising the CasX:gNA systems of any of the embodiments described herein. In some embodiments, the disclosure provides vectors comprising the nucleic acids encoding any of the CasX:gNA system embodiments described herein. In other embodiments, the disclosure provides vectors comprising the nucleic acid encoding any of the CasX:gNA embodiments described herein and, optionally, further comprising a donor template nucleic acid wherein the donor template nucleic acid comprises a nucleic acid encoding at least a portion of a SOD1 gene. In other cases, the vector comprises a nucleic acid encoding a CasX fusion protein comprising a heterologous protein, a gNA, and the donor template. In some embodiments, the vector is an Adeno-Associated Viral (AAV) vector or is a lentivirus vector. In other embodiments, the disclosure provides a vector wherein the vector is a virus-like particle comprising an RNP of a CasX and gNA of any of the embodiments described herein and, optionally, a donor template.

In some embodiments, the disclosure provides a method of modifying a target nucleic acid sequence of a SOD1 gene comprising one or more mutations in a population of cells, wherein said method comprises contacting said cells with: a) the CasX:gNA system of any of the embodiments described herein; b) a nucleic acid encoding the CasX:gNA system embodiments of (a); c) a vector comprising the nucleic acid of (b); d) a VLP comprising the CasX:gNA system of (a); or e) combinations of two or more of (a)-(d) wherein the SOD1 target nucleic acid sequence of the cells is modified by the CasX protein. In some cases, the vector is an Adeno-Associated Viral (AAV) vector or is a lentiviral vector. In some embodiments of the method, the CasX and gNA are associated together in an RNP. In other embodiments, the method further comprises contacting the target nucleic acid with a donor template comprising at least a portion of a SOD1 gene coding the SOD1 protein or the SOD1 regulatory element for correcting (by knocking in) or knocking down or knocking out the mutant SOD1 gene. In still other embodiments of the method, the cells are contacted with a second gNA or a nucleic acid encoding the second gNA, wherein the second gNA has a targeting sequence complementary to a different or overlapping portion of the SOD1 target nucleic acid compared to the first gNA, resulting in an additional break in the SOD1 target nucleic acid of the cells of the population. In other embodiments, the method further comprises contacting the target nucleic acid with an additional CRISPR protein, or a nucleic acid encoding the additional CRISPR protein wherein the additional CRISPR protein is a CasX protein having a sequence different from the first CasX. In other cases, the additional CRISPR protein is not a CasX protein, and can be a Cas9, Cas12a, Cas12b, Cas12c, Cas12d (CasY), Cas13a, Cas13b, Cas13c, Cas13d, CasX, CasY, Cas14, Cpf1, C2c1, Csn2, Cas Phi, or sequence variants thereof.

In some cases, the modifying of the target nucleic acid occurs in a cell in vitro or ex vivo. In other cases, the modifying of the target nucleic acid occurs in a cell in vivo. In some embodiments, the cells of the population to be modified is are eukaryotic cells selected from the group consisting of rodent cells, mouse cells, rat cells, primate cells, non-human primate cells, and human cells. In some embodiments, the cells of the population are selected from the group consisting of embryonic stem (ES) cells, induced pluripotent stem cell (iPSC), central nervous system (CNS) cells, and peripheral nervous system (PNS) cells. In other embodiments, the cells of the population comprise neuron cells of the CNS or the PNS. In some embodiments, the neuron cells comprise spinal motor neuron cells or oligodendrocyte cells. In other embodiments, the cells of the population are glial cells or Schwann cells of the PNS. In some embodiments, the modification of the target nucleic acid comprises correction of the mutation to the wild-type sequence.

In some embodiments of the method of modifying a SOD1 target nucleic acid sequence of a cell, the vector is administered to a subject at a therapeutically effective dose. The subject can be a rodent, a mouse, a rat, a non-human primate, or a human. The dose can be administered by a route of administration selected from the group consisting of intraparenchymal, intravenous, intra-arterial, intracerebroventricular, intracisternal, intrathecal, intracranial, lumbar, and intraperitoneal routes.

In other embodiments, the disclosure provides populations of cells modified by the foregoing methods. In some embodiments, the cell is a eukaryotic cell selected from the group consisting of a rodent cell, a mouse cell, a rat cell, a primate cell, a non-human primate cell, and a human cell. The cell can be a cell of the central nervous system (CNS) or peripheral nervous system (PNS). In some embodiments, the cells are autologous with respect to the subject to be administered the cell. In other embodiments, the cells are allogeneic with respect to the subject to be administered the cell. In some embodiments, the cell is a neuron, a spinal motor neuron, a glial cell, an oligodendrocyte, or a Schwann cell. In some embodiments, the disclosure provides a method of treating a SOD1-related disorder in a subject in need thereof, comprising administering to the subject an effective amount of the cells of the foregoing.

In other embodiments, the disclosure provides a method of treating a SOD1-related disorder in a subject in need thereof, comprising modifying a SOD1 gene having one or more mutations in the cells of the subject, the modifying comprising contacted said cells with a therapeutically effective dose of: a) the CasX:gNA system of any of the embodiments described herein; b) a nucleic acid encoding the CasX:gNA system embodiments of (a); c) a vector comprising the nucleic acid of (b); d) a VLP comprising the CasX:gNA system of (a); or e) combinations of two or more of (a)-(d) wherein the SOD1 target nucleic acid sequence of the cells is modified by the CasX protein. In some cases, the vector encodes or comprises the CasX protein and the gNA, and optionally further comprises the donor template. In some embodiments, the vector is selected from the group consisting of an Adeno-Associated Viral (AAV) vector, a retroviral vector, or a virus-like particle. In some embodiments, the subject is selected from the group consisting of mouse, rat, non-human primate, and human. In some embodiments, the vector is administered to the subject by a route of administration selected from the group consisting of intraparenchymal, intravenous, intra-arterial, intracerebroventricular, intracisternal, intrathecal, intracranial, lumbar, and intraperitoneal routes. In other embodiments, the SOD1-related disorder is amyotrophic lateral sclerosis (ALS). In some embodiments, the method results in improvement in at least one clinically-relevant endpoint in the subject selected from the group consisting of ALS Functional Rating Scale (ALSFRS-(R)), combined assessment of function and survival, duration of response, time to death, time to tracheostomy, time to persistent assisted ventilation (DTP), forced vital capacity (% FVC); manual muscle test, maximum voluntary isometric contraction, duration of response, progression-free survival, time to progression of disease, and time-to-treatment failure. In other embodiments, the method results in improvement in at least two clinically-relevant endpoints in the subject.

In some embodiments, the present disclosure provides kits comprising the nucleic acids, vectors, CasX proteins, gNAs and gene editing pairs described herein.

In another aspect, provided herein are compositions comprising gene editing pairs, or compositions of vectors comprising or encoding gene editing pairs for use as a medicament for the treatment of a subject having a SOD1 related disorder.

In another aspect, provided herein are CasX:gNA systems, compositions comprising CasX:gNA systems, vectors comprising or encoding CasX:gNA systems, VLP comprising CasX:gNA systems, or populations of cells edited using the CasX:gNA systems for use as a medicament for the treatment of a SOD1-related disorder.

In another aspect, provided herein are CasX:gNA systems, composition comprising g CasX:gNA systems, or vectors comprising or encoding CasX:gNA systems, VLP comprising CasX:gNA systems, populations of cells edited using the CasX:gNA systems, for use in a method of treatment of a SOD-1 related disorder in a subject in need thereof.

INCORPORATION BY REFERENCE

All publications, patents, and patent applications mentioned in this specification are herein incorporated by reference to the same extent as if each individual publication, patent, or patent application was specifically and individually indicated to be incorporated by reference.

The contents of PCT/US2020/036505, filed on Jun. 5, 2020, which discloses CasX variants and gNA variants, are hereby incorporated by reference in their entirety.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 33 provides Table 3, referred to herein throughout, listing SOD1 spacer sequences (SEQ ID NOs: 372-2100, 2281-12495).

DETAILED DESCRIPTION

Figure 1:
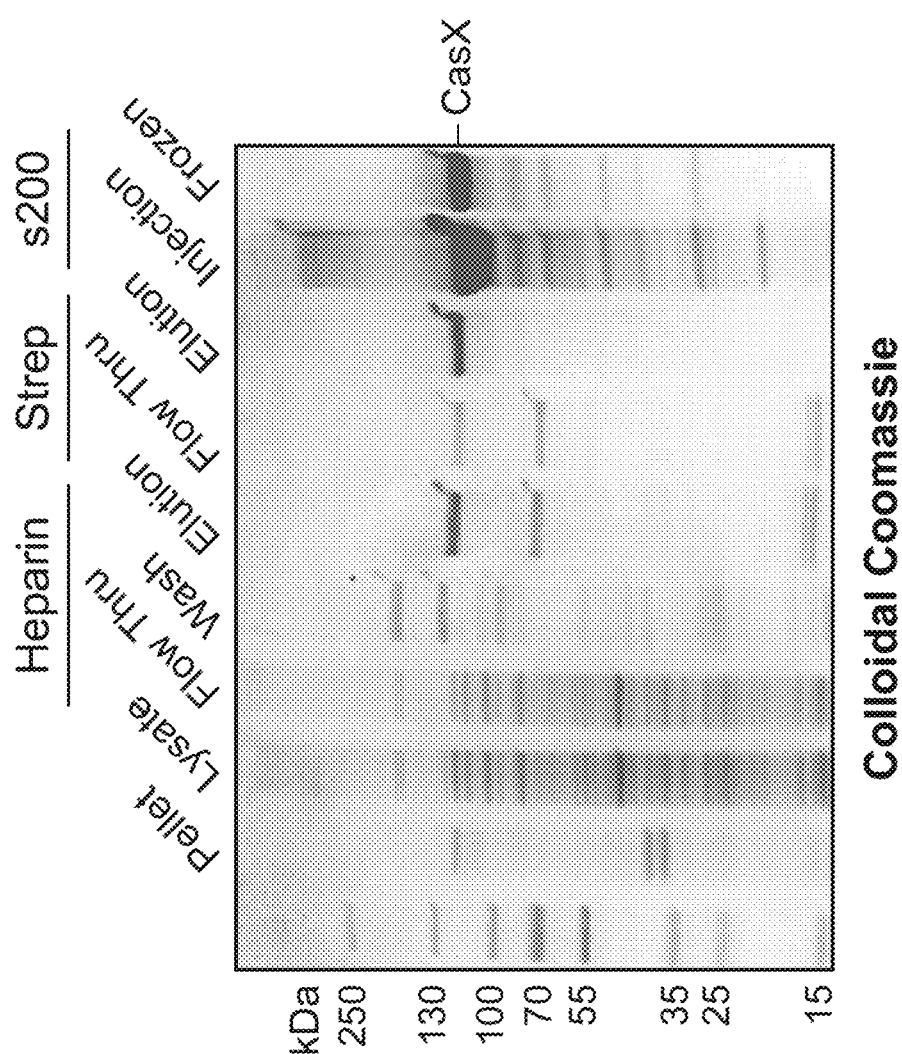
FIG. 1 shows an SDS-PAGE gel of StX2 purification fractions visualized by colloidal Coomassie staining, as described in Example 1.

While exemplary embodiments have been shown and described herein, it will be obvious to those skilled in the art that such embodiments are provided by way of example only. Numerous variations, changes, and substitutions will now occur to those skilled in the art without departing from the inventions claimed herein. It should be understood that various alternatives to the embodiments described herein may be employed in practicing the embodiments of the disclosure. It is intended that the claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present embodiments, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid to be specifically hybridizable; it can have at least about 70%, at least about 80%, or at least about 90%, or at least about 95% sequence identity and still hybridize to the target nucleic acid. Moreover, a polynucleotide may hybridize over one or more segments such that intervening or adjacent segments are not involved in the hybridization event (e.g., a loop structure or hairpin structure, a 'bulge', 'bubble' and the like).

A "gene," for the purposes of the present disclosure, includes a DNA region encoding a gene product (e.g., a protein, RNA), as well as all DNA regions which regulate the production of the gene product, whether or not such regulatory sequences are adjacent to coding and/or transcribed sequences. Accordingly, a gene may include regulatory sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed, e.g. the strand containing the coding sequence, as well as the complementary strand.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "regulatory element" is used interchangeably herein with the term "regulatory sequence," and is intended to include promoters, enhancers, and other expression regulatory elements (e.g. transcription termination signals, such as polyadenylation signals and poly-U sequences). Exemplary regulatory elements include a transcription promoter such as, but not limited to, CMV, CMV+intron A, SV40, RSV, HIV-Ltr, elongation factor 1 alpha (EF1α), MMLV-ltr, internal ribosome entry site (IRES) or P2A peptide to permit translation of multiple genes from a single transcript, metallothionein, a transcription enhancer element, a transcription termination signal, polyadenylation sequences, sequences for optimization of initiation of translation, and translation termination sequences. It will be understood that the choice of the appropriate regulatory element will depend on the encoded component to be expressed (e.g., protein or RNA) or whether the nucleic acid comprises multiple components that require different polymerases or are not intended to be expressed as a fusion protein.

The term "promoter" refers to a DNA sequence that contains an RNA polymerase binding site, transcription start site, TATA box, and/or B recognition element and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive.

The term "enhancer" refers to regulatory element DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant polypeptide" or "recombinant protein" refers to a polypeptide or protein which is not naturally occurring, e.g., is made by the artificial combination of two otherwise separated segments of amino sequence through human intervention. Thus, e.g., a protein that comprises a heterologous amino acid sequence is recombinant.

As used herein, the term "contacting" means establishing a physical connection between two or more entities. For example, contacting a target nucleic acid with a guide nucleic acid means that the target nucleic acid and the guide nucleic acid are made to share a physical connection; e.g., can hybridize if the sequences share sequence similarity.

"Dissociation constant", or "$K_d$", are used interchangeably and mean the affinity between a ligand "L" and a protein "P"; i.e., how tightly a ligand binds to a particular protein. It can be calculated using the formula $K_d=[L]$

[P]/[LP], where [P], [L] and [LP] represent molar concentrations of the protein, ligand and complex, respectively.

The disclosure provides compositions and methods useful for editing a target nucleic acid sequence. As used herein "editing" is used interchangeably with "modifying" and includes but is not limited to cleaving, nicking, deleting, knocking in, knocking out, and the like.

The term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. The term "knock-down" as used herein refers to reduction in the expression of a gene or its gene product(s). As a result of a gene knock-down, the protein activity or function may be attenuated or the protein levels may be reduced or eliminated.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor (e.g., such as the donor template) to the target. Homology-directed repair can result in an alteration of the sequence of the target nucleic acid sequence by insertion, deletion, or mutation if the donor template differs from the target DNA sequence and part or all of the sequence of the donor template is incorporated into the target DNA.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break.

A polynucleotide or polypeptide (or protein) has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a wild-type or reference amino acid sequence or to a wild-type or reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., a cell line) cultured as a unicellular entity, which eukaryotic or prokaryotic cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" is meant a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, rabbits, mice, rats and other rodents.

All publications, patents, and patent applications mentioned in this specification are herein incorporated by reference to the same extent as if each individual publication, patent, or patent application was specifically and individually indicated to be incorporated by reference.

I. General Methods

The practice of the present invention employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Harbor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kdplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the disclosure, which are, for clarity, described in the context of separate embodiments, may also be provided in combination in a single embodiment. In other cases, various features of the disclosure, which are, for brevity, described in the context of a single embodiment, may also be provided separately or in any suitable sub-combination. It is intended that all combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

II. CasX:gNA Systems for Genetic Editing of SOD1 Genes

In a first aspect, the present disclosure provides systems comprising a CRISPR nuclease and one or more guide nucleic acids (gNA) that have utility in genome editing of eukaryotic cells. In some embodiments, the CRISPR nuclease is selected from the group consisting of Cas9, Cas12a, Cas12b, Cas12c, Cas12d (CasY), CasX, Cas13a, Cas13b, Cas13c, Cas13d, CasX, CasY, Cas14, Cpf1, C2c1, Csn2, and Cas Phi. In some embodiments, the CRISPR nuclease is a is a Type V CRISPR nuclease. In some embodiments, the present disclosure provides CasX:gNA systems comprising a CasX protein and one or more guide nucleic acids (gNA) for use in modifying a SOD1 gene (collectively referred to herein as the "target nucleic acid", inclusive of coding and non-coding regions). The SOD1 gene to be modified may comprise one or more mutations in the sequence region selected from the group consisting of a SOD1 intron, a SOD1 exon, a SOD1 intron-exon junction, a SOD1 regulatory element, and an intergenic region.

In some embodiments, the CasX:gNA systems are specifically designed to modify the SOD1 gene in eukaryotic cells. Generally, any portion of the SOD1 target nucleic acid can be targeted using the programmable compositions and methods provided herein. In some embodiments, the disclosure provides CasX:gNA systems comprising one or more of a CasX protein, one or more guide nucleic acids (gNA) and, optionally, one or more donor template nucleic acids. In other cases, the CasX:gNA system is delivered to a cell to be modified using a vector, which can comprise either nucleic acids encoding the components or deliver the CasX and gNA (and optionally the donor template) in their functional form. Each of these components and their use in the editing of SOD1 target nucleic acid is described herein, below.

In some cases, a gNA and a CasX protein of the disclosure can form a complex and bind via non-covalent interactions, referred to herein as a ribonucleoprotein (RNP) complex. As provided herein, in some embodiments, the use of a pre-complexed CasX:gNA may confer advantages in the delivery of the system components to a cell or target nucleic acid for editing of the target nucleic acid. For example, in the RNP, the gNA can provide target specificity to the complex by including a guide sequence having a nucleotide sequence that is complementary to a sequence of a target nucleic acid while the CasX protein of the pre-complexed CasX:gNA provides the site-specific activity that is guided to a target site (e.g., stabilized at a target site) within a target nucleic acid sequence (e.g., a SOD1 gene to be modified) by virtue of its association with the guide NA. The CasX protein of the complex provides the site-specific activities of the complex such as cleavage or nicking of the target nucleic acid sequence by the CasX protein and/or an activity provided by the fusion partner in the case of a chimeric CasX protein. The CasX proteins and gNA components of the CasX:gNA systems and their features are described more fully, below.

In some embodiments, the CasX:gNA systems utilized in the editing of the SOD1 gene can further comprise a donor template comprising all or at least a portion of a gene encoding a SOD1 protein or encoding a SOD1 regulatory element wherein the donor template comprises one or more mutations for either knocking out or knocking down (described more fully, below) the SOD1 gene. In other cases, the CasX:gNA systems can further comprise a donor template for the introduction (or knocking in) of all or a portion of an open reading frame encoding a protein for the production of a wild-type SOD1 protein in the target cell or a sequence for correcting the one or more mutations of the SOD1 gene. In a particular embodiment of the foregoing, gNAs targeting the upstream sequence Exon 1 and Intron 1 can be used to introduce breaks that permit the insertion of full length cDNA encoding the SOD1 protein, replacing the mutated endogenous SOD1 gene and restoring protein expression. In other embodiments, the CasX:gNA systems can further comprise a donor template for the introduction of a regulatory element to correct the one or more mutations of the SOD1 regulatory element. In some embodiments, the donor polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides of a SOD1 gene, wherein the SOD1 gene portion is selected from the group consisting of a SOD1 exon, a SOD1 intron, a SOD1 intron-exon junction, a SOD1 regulatory element and an intergenic region; either a wild-type sequence or comprising one or more mutations depending on whether the modification is to knock-down/knock-out or knock-in gene function. In other embodiments, the donor polynucleotide comprises at least about 10 to about 10,000 nucleotides, or at least about 100 to about 8000 nucleotides, or at least about 400 to about 6000 nucleotides, or at least about 600 to about 4000 nucleotides, or at least about 1000 to about 2000 nucleotides of a SOD1 gene. In some embodiments, the donor template is a single stranded DNA template or a single stranded RNA template. In other embodiments, the donor template is a double stranded DNA template.

The SOD1 gene encodes superoxide dismutase-1 (EC 1.15.1.1), a cytoplasmic antioxidant enzyme that metabolizes superoxide radicals to molecular oxygen and hydrogen peroxide, thus providing a defense against oxygen toxicity (Niwa et al., JBC 282:28087 (2007)). The SOD1 gene and its regulatory element is defined as the sequence that spans chr21:31659622-31668931 of the human genome (GRCh38/hg38) (the notation refers to the chromosome 21 (chr21), starting at the 31,659,622 bp of that chromosome, and extending to the 31,668,931 bp of that chromosome). The coding region consists of five exons interrupted by four introns.

In some cases, the SOD1 regulatory element is 5' of the SOD1 gene. In other cases, the SOD1 regulatory element is 3' of the SOD1 gene. In some embodiments, a SOD1 regulatory element comprises a 5' untranslated region (UTR) of the SOD1 gene, while in other embodiments, a SOD1 regulatory element comprises a 3'UTR of the SOD1 gene.

The SOD1 regulatory element comprises a promoter, and in some cases further comprises an enhancer.

Soluble cytoplasmic SOD1 is a copper- and zinc-containing enzyme that is highly conserved throughout evolution and makes up 1-2% of the total soluble protein content in the central nervous system (Pardo Calif., et al., Cleveland D W. Superoxide dismutase is an abundant component in cell bodies, dendrites, and axons of motor neurons and in a subset of other neurons (Proc Natl Acad Sci USA. 92:954 (1995); Sherman et al., Nucleotide sequence and expression of human chromosome 21-encoded superoxide dismutase mRNA. Proc. Natl. Acad. Sci. U.S.A. 80:5465 (1983)).

The human SOD1 gene (HGNC:11179; see also GenBank Accession No. CAG46542.1) encodes a protein having the sequence (SEQ ID NO: 100)
MATKAVCVLKGDGPVQGIINFEQKESNGPVKVWGSIKGLTEGLHGFHVHE

FGDNTAGCTSAGPHFNPLSRKHGGPKDEERHVGDLGNVTADKDGVADVSI

EDSVISLSGDHCIIGRTLVVHEKADDLGKGGNEESTKTGNAGSRLACGVI

GIAQ.

Although human SOD1 contains 154 amino acids, the start methionine is cleaved post-translationally, followed by N-acetylation of the first alanine, therefore making the number of actual amino acids in SOD1 153 (Stevens, J C, et al. Modification of Superoxide Dismutase 1 (SOD1) Properties by a GFP Tag—Implications for Research into Amyotrophic Lateral Sclerosis (ALS). PLoS ONE 5(3): e9541 (2010)). At least 170 mutations across the SOD1 gene have been found to cause amyotrophic lateral sclerosis (ALS) (Pochet, R. Genetics and ALS: Cause for Optimism. Cerebrum cer-05-17 (2017)). Table 1 provides representative examples of SOD1 mutations known to contribute to, or that are associated with ALS in a subject.

TABLE 1

| ALS-associated mutations in SOD1 | | |
|---|---|---|
| SOD1 Amino Acid Position* | WT Amino Acid** | Mutant Amino Acid*** |
| 4 | A | S |
| 4 | A | T |
| 4 | A | V |
| 6 | C | F |
| 7 | V | E |
| 8 | L | Q |
| 8 | L | V |
| 12 | G | R |
| 14 | V | G |
| 14 | V | M |
| 16 | G | S |
| 20 | F | C |
| 21 | E | G |
| 21 | E | K |
| 22 | Q | L |
| 37 | G | R |
| 38 | L | R |
| 38 | L | V |
| 41 | G | D |
| 41 | G | S |
| 43 | H | R |
| 45 | F | C |
| 46 | H | R |
| 48 | H | Q |
| 48 | H | R |
| 49 | E | K |

TABLE 1-continued

ALS-associated mutations in SOD1

| SOD1 Amino Acid Position* | WT Amino Acid** | Mutant Amino Acid*** |
|---|---|---|
| 54 | T | R |
| 65 | N | S |
| 67 | L | P |
| 67 | L | R |
| 72 | G | S |
| 76 | D | Y |
| 80 | H | A |
| 84 | L | F |
| 84 | L | V |
| 85 | G | R |
| 86 | N | S |
| 87 | V | A |
| 89 | A | T |
| 89 | A | V |
| 90 | D | A |
| 90 | D | V |
| 93 | G | A |
| 93 | G | C |
| 93 | G | D |
| 93 | G | R |
| 93 | G | V |
| 95 | A | G |
| 97 | V | M |
| 100 | E | G |
| 100 | E | K |
| 101 | D | G |
| 101 | D | N |
| 104 | I | F |
| 105 | S | L |
| 106 | L | V |
| 108 | G | V |
| 111 | C | Y |
| 112 | I | M |
| 112 | I | T |
| 113 | I | T |
| 114 | G | A |
| 115 | R | G |
| 118 | V | L |
| 124 | D | G |
| 124 | D | V |
| 125 | D | H |
| 126 | L | S |
| 134 | S | N |
| 139 | N | K |
| 144 | L | F |
| 144 | L | S |
| 145 | A | T |
| 146 | C | R |
| 147 | G | R |
| 148 | V | G |
| 148 | V | I |
| 149 | I | T |
| 151 | I | T |

*Amino acid position relative to SEQ ID NO: 100 without the N-terminal methionine
**Single letter code for wild-type amino acid
***Single letter code for mutant amino acid In some cases, the mutation of the SOD1 gene in subjects with a SOD1-related disease is an insertion, deletion, substitution, duplication, or inversion of one or more nucleotides as compared to the wild-type sequence. In one case, the mutation is a gain of function mutation. In other embodiments, the mutation is a loss of function mutation. In some embodiments, the mutation is a mutation of the SOD1 protein of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T, and one or more amino acid substitutions of SEQ ID NO:100 that disrupt the function or expression of the SOD1 protein, or is selected from a combination thereof. In a particular embodiment, the SOD1 protein comprises a mutation selected from an A4V mutation of SEQ ID NO:100, a D90A mutation of SEQ ID NO:100, and/or a G93A mutation of SEQ ID NO:100. The present disclosure provides compositions and methods for the editing of nucleic acids comprising these mutations.

III. Guide Nucleic Acids of the Systems for Genetic Editing

In another aspect, the disclosure relates to a guide nucleic acid (gNA) comprising a targeting sequence complementary to a target nucleic acid sequence in the target strand of a gene encoding a SOD1 protein, wherein the gNA is capable of forming a complex with a CRISPR protein that is specific to a protospacer adjacent motif (PAM) sequence comprising a TC motif in the complementary non-target strand, and wherein the PAM sequence is located 1 nucleotide 5' of the sequence in the non-target strand that is complementary to the target nucleic acid sequence in the target strand.

In another aspect, the disclosure relates to guide nucleic acids (gNA) utilized in the CasX:gNA systems that have utility in genome editing a SOD1 gene in a cell. In some embodiments, the present disclosure provides guide nucleic acids capable of forming a RNP complex with a CasX protein in which the gNA binds to the CasX protein, and wherein the targeting sequence (or spacer, described more fully, below) of the gNA is complementary to, and therefore is capable of hybridizing with the SOD1 gene sequence. In some embodiments, the gNA is a deoxyribonucleic acid molecule ("gDNA"). In some embodiments, the gNA is a ribonucleic acid molecule ("gRNA"). In some embodiments, the gNA is a chimera, and comprises both DNA and RNA (a "chimera").

The present disclosure provides specifically-designed guide nucleic acids ("gNAs") with targeting sequences that are complementary to, and are therefore able to hybridize with either strand of the SOD1 gene as a component of the gene editing CasX:gNA systems. As described more fully, below, representative, but non-limiting examples of targeting sequences to the SOD1 target nucleic acid are presented in Table 3 (Table 3 is provided in FIG. 33). It is envisioned that in some embodiments, multiple gNAs (e.g., multiple gRNAs) are delivered in the CasX:gNA system for the modification of a gene encoding one or more regions of a SOD1 protein, a non-coding region of the SOD1 gene, or a SOD1 regulatory element. For example, when a deletion or a knock-down/knock-out of a SOD1 intron is desired, a pair of gNAs with targeting sequences to different or overlapping regions of the target nucleic acid sequence can be used in order to bind and the CasX to cleave at two different or overlapping sites within or proximal to the intron of the gene, which is then edited by non-homologous end joining (NHEJ), homology-directed repair (HDR, which can include, for example, insertion of a donor template to replace all or a portion of the SOD1 intron), homology-independent targeted integration (HITI), micro-homology mediated end joining (MMEJ), single strand annealing (SSA) or base excision repair (BER).

a. Reference gNA and gNA Variants

In some embodiments, a gNA of the present disclosure comprises a sequence of a naturally-occurring gNA (a "reference gNA"). In other cases, a reference gNA of the disclosure may be subjected to one or more mutagenesis methods, such as the mutagenesis methods described herein, which may include Deep Mutational Evolution (DME), deep mutational scanning (DMS), error prone PCR, cassette mutagenesis, random mutagenesis, staggered extension PCR, gene shuffling, or domain swapping, in order to generate one or more gNA variants with enhanced or varied properties relative to the reference gNA. gNA variants also include variants comprising one or more exogenous sequences, for example fused to either the 5' or 3' end of the gNA, or inserted internally. The activity of reference gNAs may be used as a benchmark against which the activity of gNA variants are compared, thereby measuring improvements in function or other characteristics of the gNA variants. In other embodiments, a reference gNA may be subjected to one or more deliberate, targeted mutations in order to produce a gNA variant, for example a rationally designed variant. As used herein, the terms gNA, gRNA, and gDNA cover naturally-occurring molecules, as well as sequence variants. Thus, in some embodiments, the gNA is a deoxyribonucleic acid molecule ("gDNA"); in some embodiments, the gNA is a ribonucleic acid molecule ("gRNA"), and in other embodiments, the gNA is a chimera, and comprises both DNA and RNA.

The gNAs of the disclosure comprise two segments: a targeting sequence and a protein-binding segment. The targeting segment of a gNA includes a nucleotide sequence (referred to interchangeably as a guide sequence, a spacer, a targeting sequence, or a targeting region) that is complementary to (and therefore hybridizes with) a specific sequence (a target site) within the target nucleic acid sequence (e.g., a target ssRNA, a target ssDNA, a strand of a double stranded target DNA, etc.), described more fully below. The targeting sequence of a gNA is capable of binding to a target nucleic acid sequence, including a coding sequence, a complement of a coding sequence, a non-coding sequence, and to regulatory elements. The protein-binding segment (or "protein-binding sequence") interacts with (e.g., binds to) a CasX protein. The protein-binding segment is alternatively referred to herein as a "scaffold", which is comprised of several regions, described more fully, below. In some embodiments, the targeting sequence and scaffold each include complementary stretches of nucleotides that hybridize to one another to form a double stranded duplex (dsRNA duplex for a gRNA). Site-specific binding and/or cleavage of a target nucleic acid sequence (e.g., genomic DNA) by the CasX:gNA can occur at one or more locations (e.g., a sequence of a target nucleic acid) determined by base-pairing complementarity between the targeting sequence of the gNA and the target nucleic acid sequence.

The targeting sequence of a gNA is capable of binding to a SOD1 target nucleic acid sequence, including a coding sequence, a complement of a coding sequence, a non-coding sequence, and to regulatory elements. The gNA scaffold (or "protein-binding sequence") interacts with (e.g., binds to) a CasX protein, forming an RNP (described more fully, below). In some embodiments, the targeting sequence and scaffold each include complementary stretches of nucleotides that hybridize to one another to form a double stranded duplex (dsRNA duplex for a dgRNA). Site-specific binding and/or cleavage of a target nucleic acid sequence (e.g., genomic DNA) by the CasX protein can occur at one or more locations (e.g., a sequence of a target nucleic acid) determined by base-pairing complementarity between the targeting sequence of the gNA and the target nucleic acid sequence. Thus, for example, the gNA of the disclosure have sequences complementarity to and therefore can hybridize to a sequence in a eukaryotic cell, e.g., a eukaryotic nucleic acid (e.g., a eukaryotic chromosome, chromosomal sequence, a eukaryotic RNA, etc.) that is adjacent to a sequence complementary to a TC PAM motif or a PAM sequence, such as ATC, CTC, GTC, or TTC.

In the context of nucleic acids, cleavage refers to the breakage of the covalent backbone of a nucleic acid molecule; either DNA or RNA. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends.

In some embodiments, the disclosure provides gene editing pairs of a CasX and a gNA of any of the embodiments described herein that are capable of being bound together prior to their use for gene editing and, thus, are "pre-complexed" as a ribonuclear protein complex (RNP). The use of a pre-complexed RNP confers advantages in the delivery of the system components to a cell or target nucleic acid sequence for editing of the target nucleic acid sequence. The CasX protein of the RNP provides the site-specific activity that is guided to a target site (e.g., stabilized at a target site) within a target nucleic acid sequence by virtue of its association with the guide RNA comprising a targeting sequence capable of hybridizing to the target nucleic acid sequence.

In some embodiments, wherein the gNA is a gRNA, the term "targeter" or "targeter RNA" is used herein to refer to a crRNA-like molecule (crRNA: "CRISPR RNA") of a CasX dual guide RNA (and therefore of a CasX single guide RNA when the "activator" and the "targeter" are linked together, e.g., by intervening nucleotides). Thus, for example, a CasX guide RNA (dgRNA or sgRNA) comprises a guide sequence and a duplex-forming segment of a crRNA, which can also be referred to as a crRNA repeat. Because the sequence of a guide sequence hybridizes with a sequence of a SOD1 target nucleic acid sequence, a targeter can be modified by a user to hybridize with a specific target nucleic acid sequence. Thus, in some cases, the sequence of a targeter may be a non-naturally occurring sequence. In other cases, the sequence of a targeter may be a naturally-occurring sequence, derived from the gene to be edited. In the case of a dual guide RNA, the targeter and the activator each have a duplex-forming segment, where the duplex forming segment of the targeter and the duplex-forming segment of the activator have complementarity with one another and hybridize to one another to form a double stranded duplex (dsRNA duplex for a gRNA). In some embodiments, a targeter comprises both the guide sequence of the guide RNA and a stretch of nucleotides that forms one half of the dsRNA duplex of the protein-binding segment of the gRNA. A corresponding tracrRNA-like molecule (activator) also comprises a duplex-forming stretch of nucleotides that forms the other half of the dsRNA duplex of the protein-binding segment of the CasX guide RNA. Thus, a targeter and an activator, as a corresponding pair, hybridize to form a CasX dual guide NA, referred to herein as a "dual guide NA", a "dual-molecule gNA", a "dgNA", a "double-molecule guide NA", or a "two-molecule guide NA".

In some embodiments, the activator and targeter of the reference gNA are covalently linked to one another and comprise a single molecule, referred to herein as a "single-molecule gNA," "one-molecule guide NA," "single guide NA", "single guide RNA", a "single-molecule guide RNA," a "one-molecule guide RNA", a "single guide DNA", a "single-molecule guide DNA", or a "one-molecule guide DNA", ("sgNA", "sgRNA", or a "sgDNA"). In some embodiments, the sgNA includes an "activator" or a "targeter" and thus can be an "activator-RNA" and a "targeter-RNA," respectively.

Collectively, the gNAs of the disclosure comprise four distinct regions, or domains: the RNA triplex, the scaffold stem, the extended stem, and the targeting sequence that, in the embodiments of the disclosure are specific for a target nucleic acid. The RNA triplex, the scaffold stem, and the extended stem, together, are referred to as the "scaffold" of the gNA. In some embodiments, the targeting sequence is on the 3' end of the gNA.

b. RNA Triplex

In some embodiments of the guide NAs provided herein (including reference sgRNAs), there is a RNA triplex, and the RNA triplex comprises the sequence of a UUU-nX(~4-15)-UUU (SEQ ID NO: 17) stem loop that ends with an AAAG after 2 intervening stem loops (the scaffold stem loop and the extended stem loop), forming a pseudoknot that may also extend past the triplex into a duplex pseudoknot. The UU-UUU-AAA sequence of the triplex forms as a *nexus* between the targeting sequence, scaffold stem, and extended stem. In exemplary CasX sgRNAs, the UUU-loop-UUU region is coded for first, then the scaffold stem loop, and then the extended stem loop, which is linked by the tetraloop, and then an AAAG closes off the triplex before becoming the targeting sequence.

c. Scaffold Stem Loop

In some embodiments of sgNAs of the disclosure, the triplex region is followed by the scaffold stem loop. The scaffold stem loop is a region of the gNA that is bound by CasX protein (such as a reference or CasX variant protein). In some embodiments, the scaffold stem loop is a fairly short and stable stem loop. In some cases, the scaffold stem loop does not tolerate many changes, and requires some form of an RNA bubble. In some embodiments, the scaffold stem is necessary for CasX sgNA function. While it is perhaps analogous to the *nexus* stem of Cas9 as being a critical stem loop, the scaffold stem of a CasX sgNA, in some embodiments, has a necessary bulge (RNA bubble) that is different from many other stem loops found in CRISPR/Cas systems. In some embodiments, the presence of this bulge is conserved across sgNA that interact with different CasX proteins. An exemplary sequence of a scaffold stem loop sequence of a gNA comprises the sequence CCAGCGAC-UAUGUCGUAUGG (SEQ ID NO: 14). In other embodiments, the disclosure provides gNA variants wherein the scaffold stem loop is replaced with an RNA stem loop sequence from a heterologous RNA source with proximal 5' and 3' ends, such as, but not limited to stem loop sequences selected from MS2, Q β, U1 hairpin II, Uvsx, or PP7 stem loops. In some cases, the heterologous RNA stem loop of the gNA is capable of binding a protein, an RNA structure, a DNA sequence, or a small molecule d. Extended Stem Loop In some embodiments of the CasX sgNAs of the disclosure, the scaffold stem loop is followed by the extended stem loop. In some embodiments, the extended stem comprises a synthetic tracr and crRNA fusion that is largely unbound by the CasX protein. In some embodiments, the extended stem loop can be highly malleable. In some embodiments, a single guide gRNA is made with a GAAA tetraloop linker or a GAGAAA linker between the tracr and crRNA in the extended stem loop. In some cases, the targeter and activator of a CasX sgNA are linked to one another by intervening nucleotides and the linker can have a length of from 3 to 20 nucleotides. In some embodiments of the CasX sgNAs of the disclosure, the extended stem is a large 32-bp loop that sits outside of the CasX protein in the ribonucleoprotein complex. An exemplary sequence of an extended stem loop sequence of a sgNA comprises the sequence GCGC-UUAUUUAUCGGAGAGAAAUCCGAUAAAUAA-GAAGC (SEQ ID NO: 15). In some embodiments, the extended stem loop comprises a GAGAAA spacer sequence. In some embodiments, the disclosure provides gNA variants wherein the extended stem loop is replaced with an RNA stem loop sequence from a heterologous RNA source with proximal 5' and 3' ends, such as, but not limited to stem loop sequences selected from MS2, Qβ, U1 hairpin II, Uvsx, or PP7 stem loops. In such cases, the heterologous RNA stem loop increases the stability of the gNA. In other embodiments, the disclosure provides gNA variants having an extended stem loop region comprising at least 10, at least 100, at least 500, at least 1000, or at least 10,000 nucleotides.

e. Targeting Sequence

In some embodiments of the gNAs of the disclosure, the extended stem loop is followed by a region that forms part of the triplex, and then the targeting sequence (or "spacer"). The targeting sequence targets the CasX ribonucleoprotein holo complex to a specific region of the target nucleic acid sequence of the SOD1 gene. Thus, for example, gNA targeting sequences of the disclosure have sequences complementarity to, and therefore can hybridize to, a portion of the SOD1 gene in a nucleic acid in a eukaryotic cell (e.g., a eukaryotic chromosome, chromosomal sequence, a eukaryotic RNA, etc.) as a component of the RNP when any one of the PAM sequences TTC, ATC, GTC, or CTC is located 1 nucleotide 5' to the non-target strand sequence complementary to the target sequence. The targeting sequence of a gNA can be modified so that the gNA can target a desired sequence of any desired target nucleic acid sequence, so long as the PAM sequence location is taken into consideration. In some embodiments, the gNA scaffold is 5' of the targeting sequence, with the targeting sequence on the 3' end of the gNA. In some embodiments, the PAM sequence recognized by the RNP is TC. In other embodiments, the PAM sequence recognized by the RNP is NTC.

In some embodiments, the targeting sequence of the gNA is specific for a portion of a gene encoding a SOD1 protein. In some embodiments, the targeting sequence of a gNA is specific for a SOD1 exon. In one embodiment, the targeting sequence of a gNA is specific for SOD1 exon 1. In another embodiment, the targeting sequence of a gNA is specific for SOD1 exon 2. In another embodiment, the targeting sequence of a gNA is specific for SOD1 exon 3. In another embodiment, the targeting sequence of a gNA is specific for SOD1 exon 4. In another embodiment, the targeting sequence of a gNA is specific for SOD1 exon 5. In some embodiments, the targeting sequence of a gNA is specific for a SOD1 intron. In some embodiments, the targeting sequence of the gNA is specific for a SOD1 intron-exon junction. In some embodiments, the targeting sequence of the gNA has a sequence that hybridizes with a SOD1 regulatory element, a SOD1 coding region, a SOD1 non-coding region, or combinations thereof (e.g., the intersection of two regions). In some embodiments, the targeting sequence of the gNA is complementary to a sequence comprising one or more single nucleotide polymorphisms (SNPs) of the SOD1 gene or its complement. SNPs that are within a SOD1 coding sequence or within a SOD1 non-coding sequence are both within the scope of the instant disclosure. In other embodiments, the targeting sequence of the gNA is complementary to a sequence of an intergenic region of the SOD1 gene.

In some embodiments, the targeting sequence of a gNA is designed to be specific for a regulatory element that regulates expression of the SOD1 gene product. Such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the gene of the target nucleic acid. In the foregoing, the targets are those in which the encoding gene of the target is intended to be knocked out or knocked down such that the SOD1 protein comprising mutations is not expressed or is expressed at a lower level in a cell.

In some embodiments, the targeting sequence of the gNA has between 14 and 35 consecutive nucleotides. In some embodiments, the targeting sequence has 14, 15, 16, 18, 18, 19, 20, 21, 22, 23 24, 25, 26, 27, 28, 29, 30, 31, 32, 33, 34 or 35 consecutive nucleotides. In some embodiments, the targeting sequence consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. In some embodiments, the targeting sequence has 14, 15, 16, 17, 18, 19, 20, 21, 22, 23, 24, 25, 26, 27, 28, 29, 30, 31, 32, 33, 34 or 35 consecutive nucleotides and the targeting sequence can comprise 0 to 5, 0 to 4, 0 to 3, or 0 to 2 mismatches relative to the target nucleic acid sequence and retain sufficient binding specificity such that the RNP comprising the gNA comprising the targeting sequence can form a complementary bond with respect to the target nucleic acid.

Representative, but non-limiting examples of targeting sequences for inclusion in the gNA of the disclosure are presented in Table 3 (provided as FIG. 33). In Table 3, the first column indicates the PAM sequence, and the second column indicates the SEQ ID of the accompanying spacer sequence (sometimes referred to herein as the targeting sequence). In some embodiments, the disclosure provides targeting sequences for inclusion in the gNA of the disclosure comprising a sequence that is at least 50% identical, at least 55% identical, at least 60% identical, at least 65% identical, at least 70% identical, at least 75% identical, at least 80% identical, at least 85% identical, at least 90% identical, at least 95% identical, or 100% identical to a sequence in Table 3 (FIG. 33). In some embodiments, the targeting sequence of the gNA comprises a sequence a sequence of Table 3 with a single nucleotide removed from the 3' end of the sequence. In other embodiments, the targeting sequence of the gNA comprises a sequence a sequence of Table 3 with two nucleotides removed from the 3' end of the sequence. In other embodiments, the targeting sequence of the gNA comprises a sequence a sequence of Table 3 with three nucleotides removed from the 3' end of the sequence. In other embodiments, the targeting sequence of the gNA comprises a sequence a sequence of Table 3 with four nucleotides removed from the 3' end of the sequence. In other embodiments, the targeting sequence of the gNA comprises a sequence a sequence of Table 3 with five nucleotides removed from the 3' end of the sequence. In the foregoing embodiments of the paragraph, thymine (T) nucleotides can be substituted for one or more or all of the uracil (U) nucleotides in any of the targeting sequences such that the gNA can be a gDNA or a gRNA, or a chimera of RNA and DNA. In some embodiments, a targeting sequence of Table 3 has at least 1, 2, 3, 4, 5, or 6 or more thymine nucleotides substituted for uracil nucleotides. In other embodiments, a gNA, gRNA, or gDNA of the disclosure comprises 1, 2, 3 or more targeting sequences of Table 3, or targeting sequences that are at least 50% identical, at least 55% identical, at least 60% identical, at least 65% identical, at least 70% identical, at least 75% identical, at least 80% identical, at least 85% identical, at least 90% identical, at least 95% identical, or 100% identical to one or more sequences of Table 3.

In some embodiments, the targeting sequence of the gNA encodes or is complementary to a nucleic acid sequence encoding a mutation of the SOD1 protein of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T, and one or more amino acid substitutions of SEQ ID NO:100 that disrupt the function or expression of the SOD1 protein, or is selected from a combination thereof. In a particular embodiment, the targeting sequence of the gNA is complementary to a nucleic acid sequence encoding a mutation of the SOD1 protein of SEQ ID NO:100 selected from an A4V mutation of SEQ ID NO:100, a D90A mutation of SEQ ID NO:100, a G93A mutation of SEQ ID NO:100, or a combination thereof.

In some embodiments, the CasX:gNA system comprises a first gNA and further comprises a second (and optionally a third, fourth, fifth, or more) gNA, wherein the second gNA or additional gNA has a targeting sequence complementary to a different or overlapping portion of the target nucleic acid sequence compared to the targeting sequence of the first gNA such that multiple points in the target nucleic acid are targeted, and, for example, multiple breaks are introduced in the target nucleic acid by the CasX. It will be understood that in such cases, the second or additional gNA is complexed with an additional copy of the CasX protein. By selection of the targeting sequences of the gNA, defined regions of the target nucleic acid sequence bracketing a particular location within the target nucleic acid can be modified or edited using the CasX:gNA systems described herein, including facilitating the insertion of a donor template.

f. gNA Scaffolds

With the exception of the targeting sequence domain, the remaining components of the gNA are referred to herein as the scaffold. In some embodiments, the gNA scaffolds are derived from naturally-occurring sequences, described below as reference gNA. In other embodiments, the gNA scaffolds are variants of reference gNA wherein mutations, insertions, deletions or domain substitutions are introduced to confer desirable properties on the gNA.

In some embodiments, a CasX reference gRNA comprises a sequence isolated or derived from *Deltaproteobacter*. In some embodiments, the sequence is a CasX tracrRNA sequence. Exemplary CasX reference tracrRNA sequences isolated or derived from *Deltaproteobacter* may include: ACAUCUGGCGCGUUUAUUCCAUUACUUUGGAGC-CAGUCCCAGCGACUAUGUCG UAUGGACGAAGCG-CUUAUUUAUCGGAGA (SEQ ID NO: 6) and ACAUCUGGCGCGUUUAUUCCAUUACUUUG-GAGCCAGUCCCAGCGACUAUGUCG UAUGGACG-AAGCGCUUAUUUAUCGG (SEQ ID NO: 7). Exemplary crRNA sequences isolated or derived from Deltaproteobacter may comprise a sequence of CCGAUA-AGUAAAACGCAUCAAAG (SEQ ID NO: 18). In some embodiments, a CasX reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from *Deltaproteobacter*.

In some embodiments, a CasX reference guide RNA comprises a sequence isolated or derived from *Planctomycetes*. In some embodiments, the sequence is a CasX tracrRNA sequence. Exemplary CasX reference tracrRNA sequences isolated or derived from *Planctomycetes* may include: UACUGGCGCUUUUAUCUCAUUACUUUG-AGAGCCAUCACCAGCGACUAUGUCGU AUGG-GUAAAGCGCUUAUUUAUCGGAGA (SEQ ID NO: 8) and UACUGGCGCUUUUAUCUCAUUACUUUGAGA-GCCAUCACCAGCGACUA UGUCGUAUGGGUAA-AGCGCUUAUUUAUCGG (SEQ ID NO: 9). Exemplary crRNA sequences isolated or derived from *Planctomycetes* may comprise a sequence of UCUCCGAUAA-AUAAGAAGCAUCAAAG (SEQ ID NO: 19). In some embodiments, a CasX reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from *Planctomycetes*.

In some embodiments, a CasX reference gNA comprises a sequence isolated or derived from *Candidatus Sungbacteria*. In some embodiments, the sequence is a CasX tracrRNA sequence. Exemplary CasX reference tracrRNA sequences isolated or derived from *Candidatus Sungbacteria* may comprise sequences of: GUUUACACACUCCCU-CUCAUAGGGU (SEQ ID NO: 10), GUUUACACA-CUCCCUCUCAUGAGGU (SEQ ID NO: 11), UUUUACAUACCCCCUCUCAUGGGAU (SEQ ID NO: 12) and GUUUACACACUCCCUCUCAUGGGGG (SEQ ID NO: 13). In some embodiments, a CasX reference guide RNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from *Candidatus sungbacteria*.

Table 2A provides the sequences of reference gRNAs tracr and scaffold sequences. In some embodiments, the disclosure provides gNA sequences wherein the gNA has a scaffold comprising a sequence having at least one nucleotide modification relative to a reference gNA sequence having a sequence of any one of SEQ ID NOS: 4-16 of Table 2A. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 2A

| | Reference gRNA tracr and scaffold sequences |
|---|---|
| SEQ ID NO. | Nucleotide Sequence |
| 4 | ACAUCUGGCGCGUUUAUUCCAUUACUUUGGAGCCAGUCCCAGCGACUAUGUCG UAUGGACGAAGCGCUUAUUUAUCGGAGAGAAACCGAUAAGUAAAACGCAUCAA AG |
| 5 | UACUGGCGCUUUUAUCUCAUUACUUUGAGAGCCAUCACCAGCGACUAUGUCGU AUGGGUAAAGCGCUUAUUUAUCGGAGAGAAAUCCGAUAAAUAAGAAGCAUCAA AG |
| 6 | ACAUCUGGCGCGUUUAUUCCAUUACUUUGGAGCCAGUCCCAGCGACUAUGUCG UAUGGACGAAGCGCUUAUUUAUCGGAGA |
| 7 | ACAUCUGGCGCGUUUAUUCCAUUACUUUGGAGCCAGUCCCAGCGACUAUGUCG UAUGGACGAAGCGCUUAUUUAUCGG |
| 8 | UACUGGCGCUUUUAUCUCAUUACUUUGAGAGCCAUCACCAGCGACUAUGUCGU AUGGGUAAAGCGCUUAUUUAUCGGAGA |

TABLE 2A-continued

Reference gRNA tracr and scaffold sequences

| SEQ ID NO. | Nucleotide Sequence |
|---|---|
| 9 | UACUGGCGCUUUUAUCUCAUUACUUUGAGAGCCAUCACCAGCGACUAUGUCGUAUGGGUAAAGCGCUUAUUUAUCGG |
| 10 | GUUUACACACUCCCUCUCAUAGGGU |
| 11 | GUUUACACACUCCCUCUCAUGAGGU |
| 12 | UUUUACAUACCCCCUCUCAUGGGAU |
| 13 | GUUUACACACUCCCUCUCAUGGGGG |
| 14 | CCAGCGACUAUGUCGUAUGG |
| 15 | GCGCUUAUUUAUCGGAGAGAAAUCCGAUAAAUAAGAAGC |
| 16 | GGCGCUUUUAUCUCAUUACUUUGAGAGCCAUCACCAGCGACUAUGUCGUAUGGGUAAAGCGCUUAUUUAUCGGA | g. gNA Variants

In another aspect, the disclosure relates to guide nucleic acid variants (referred to herein alternatively as "gNA variant" or "gRNA variant"), which comprise one or more modifications relative to a reference gRNA scaffold. As used herein, "scaffold" refers to all parts to the gNA necessary for gNA function with the exception of the spacer sequence.

In some embodiments, a gNA variant comprises one or more nucleotide substitutions, insertions, deletions, or swapped or replaced regions relative to a reference gRNA sequence of the disclosure. In some embodiments, a mutation can occur in any region of a reference gRNA scaffold to produce a gNA variant. In some embodiments, the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4 or SEQ ID NO: 5.

In some embodiments, a gNA variant comprises one or more nucleotide changes within one or more regions of the reference gRNA that improve a characteristic relative to the reference gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In one embodiment, the gNA variant scaffold comprises a scaffold stem loop having at least 60% sequence identity to SEQ ID NO: 14. In another embodiment, the gNA variant comprises a scaffold stem loop having the sequence of CCAGCGACUAUGUCGUAGUGG (SEQ ID NO: 20). In another embodiment, the disclosure provides a gNA scaffold comprising, relative to SEQ ID NO: 5, a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem was converted to a fully base-paired stem contiguous with the new Uvsx hairpin by deletion of the A99 and substitution of G64U. In the foregoing embodiment, the gNA scaffold comprises the sequence (SEQ ID NO: 2238)
ACUGGCGCUUUUAUCUGAUUACUUUGAGAGCCAUCACCAGCGACUAUGUC
GUAGUGGGUAAAGCUCCCUCUUCGGAGGGAGCAUCAAAG.

All gNA variants that have one or more improved functions or characteristics, or add one or more new functions when the variant gNA is compared to a reference gRNA described herein, are envisaged as within the scope of the disclosure. A representative example of such a gNA variant is guide 174 (SEQ ID NO: 2238), the design of which (and the rationale for the design) is described in the Examples. In some embodiments, the gNA variant adds a new function to the RNP comprising the gNA variant. In some embodiments, the gNA variant has an improved characteristic selected from: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target DNA when complexed with a CasX protein; improved gene editing when complexed with a CasX protein; improved specificity of editing when complexed with a CasX protein; and improved ability to utilize a greater spectrum of one or more PAM sequences, including ATC, CTC, GTC, or TTC, in the editing of target DNA when complexed with a CasX protein, or any combination thereof. In some cases, the one or more of the improved characteristics of the gNA variant is at least about 1.1 to about 100,000-fold improved relative to the reference gNA of SEQ ID NO: 4 or SEQ ID NO: 5. In other cases, the one or more improved characteristics of the gNA variant is at least about 1.1, at least about 10, at least about 100, at least about 1000, at least about 10,000, at least about 100,000-fold or more improved relative to the reference gNA of SEQ ID NO: 4 or SEQ ID NO: 5. In other cases, the one or more of the improved characteristics of the gNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000- fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference gNA of SEQ ID NO: 4 or SEQ ID NO: 5. In other cases, the one or more improved characteristics of the gNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to the reference gNA of SEQ ID NO: 4 or SEQ ID NO: 5.

In some embodiments, a gNA variant can be created by subjecting a reference gRNA to a one or more mutagenesis methods, such as the mutagenesis methods described herein, below, which may include Deep Mutational Evolution (DME), deep mutational scanning (DMS), error prone PCR, cassette mutagenesis, random mutagenesis, staggered extension PCR, gene shuffling, or domain swapping, in order to generate the gNA variants of the disclosure. The activity of reference gRNAs may be used as a benchmark against which the activity of gNA variants are compared, thereby measuring improvements in function of gNA variants compared to the reference gNA. In other embodiments, a reference gRNA may be subjected to one or more deliberate, targeted mutations, substitutions, or domain swaps in order to produce a gNA variant, for example a rationally designed variant. Exemplary gRNA variants produced by such methods are described in the Examples and representative sequences of gNA scaffolds are presented in Table 2B.

In some embodiments, the gNA variant comprises one or more modifications compared to a reference guide nucleic acid scaffold sequence, wherein the one or more modification is selected from: at least one nucleotide substitution in a region of the gNA variant; at least one nucleotide deletion in a region of the gNA variant; at least one nucleotide insertion in a region of the gNA variant; a substitution of all or a portion of a region of the gNA variant; a deletion of all or a portion of a region of the gNA variant; or any combination of the foregoing. In some cases, the modification is a substitution of 1 to 15 consecutive or non-consecutive nucleotides in the gNA variant in one or more regions. In other cases, the modification is a deletion of 1 to 10 consecutive or non-consecutive nucleotides in the gNA variant in one or more regions. In other cases, the modification is an insertion of 1 to 10 consecutive or non-consecutive nucleotides in the gNA variant in one or more regions. In other cases, the modification is a substitution of the scaffold stem loop or the extended stem loop with an RNA stem loop sequence from a heterologous RNA source with proximal 5' and 3' ends. In some cases, a gNA variant of the disclosure comprises two or more modifications in one region. In other cases, a gNA variant of the disclosure comprises modifications in two or more regions. In other cases, a gNA variant comprises any combination of the foregoing modifications described in this paragraph.

In some embodiments, a 5' G is added to a gNA variant sequence for expression in vivo, as transcription from a U6 promoter is more efficient and more consistent with regard to the start site when the +1 nucleotide is a G. In other embodiments, two 5' Gs are added to a gNA variant sequence for in vitro transcription to increase production efficiency, as T7 polymerase strongly prefers a G in the +1 position and a purine in the +2 position. In some cases, the 5' G bases are added to the reference scaffolds of Table 2A. In other cases, the 5' G bases are added to the variant scaffolds of Table 2B.

Table 2B provides exemplary gNA variant scaffold sequences. In Table 2B, (−) indicates a deletion at the specified position(s) relative to the reference sequence of SEQ ID NO: 5, (+) indicates an insertion of the specified base(s) at the position indicated relative to SEQ ID NO: 5, (:) indicates the range of bases at the specified start:stop coordinates of a deletion or substitution relative to SEQ ID NO: 5, and multiple insertions, deletions or substitutions are separated by commas; e.g., A14C, U17G. In some embodiments, the gNA variant scaffold comprises any one of the sequences listed in Table 2B, SEQ ID NOS: 2101-2280, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 2B

Exemplary gNA Scaffold Sequences

| SEQ ID NO: | NAME or Modification | NUCLEOTIDE SEQUENCE |
|---|---|---|
| 2101 | phage replication stable | UACUGGCGCUUUUAUCUCAUUACUUUGAGAGCCAUCACCAGCGACUA UGUCGUAUGGGUAAAGCGCAGGUGGGACGACCUCUCGGUCGUCCUAU CUGAAGCAUCAAAG |
| 2102 | Kissing loop_b1 | UACUGGCGCUUUUAUCUCAUUACUUUGAGAGCCAUCACCAGCGACUA UGUCGUAUGGGUAAAGCGCUGCUCGACGCGUCCUCGAGCAGAAGCAU CAAAG |
| 2103 | Kissing loop_a | UACUGGCGCUUUUAUCUCAUUACUUUGAGAGCCAUCACCAGCGACUA UGUCGUAUGGGUAAAGCGCUGCUCGCUCCGUUCGAGCAGAAGCAUCA AAG |

TABLE 2B-continued

Exemplary gNA Scaffold Sequences

| SEQ ID NO: | NAME or Modification | NUCLEOTIDE SEQUENCE |
|---|---|---|
| 2104 | 32: uvsX hairpin | GUACUGGCGCUUUUAUCUCAUUACUUUGAGAGCCAUCACCAGCGACUAUGUCGUAUGGGUAAAGCGCCCUCUUCGGAGGGAAGCAUCAAAG |
| 2105 | PP7 | UACUGGCGCUUUUAUCUCAUUACUUUGAGAGCCAUCACCAGCGACUAUGUCGUAUGGGUAAAGCGCAGGAGUUUCUAUGGAAACCCUGAAGCAUCAAAG |
| 2106 | 64: trip mut, extended stem truncation | GUACUGGCGCCUUUAUCUCAUUACUUUGAGAGCCAUCACCAGCGACUAUGUCGUAUGGGUAAAGCGCUUACGGACUUCGGUCCGUAAGAAGCAUCAG |
| 2107 | hyperstable tetraloop | UACUGGCGCUUUUAUCUCAUUACUUUGAGAGCCAUCACCAGCGACUAUGUCGUAUGGGUAAAGCGCUGCGCUUGCGCAGAAGCAUCAAAG |
| 2108 | C18G | UACUGGCGCUUUUAUCUGAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2109 | U17G | UACUGGCGCUUUUAUCGCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2110 | CUUCGG loop | UACUGGCGCUUUUAUCUCAUUACUUUGAGAGCCAUCACCAGCGACUAUGUCGUAUGGGUAAAGCGCUUAUUUAUCGGAGACUUCGGUCCGAUAAAUAAGAAGCAUCAAAG |
| 2111 | MS2 | UACUGGCGCUUUUAUCUCAUUACUUUGAGAGCCAUCACCAGCGACUAUGUCGUAUGGGUAAAGCGCACAUGAGGAUUACCCAUGUGAAGCAUCAAAG |
| 2112 | -1, A2G, -78, G77U | GCUGGCGCUUUUAUCUCAUUACUUUGAGAGCCAUCACCAGCGACUAUGUCGUAUGGGUAAAGCGCUUAUUUAUCGUGAGAAAUCCGAUAAAUAAGAAGCAUCAAAG |
| 2113 | QB | UACUGGCGCUUUUAUCUCAUUACUUUGAGAGCCAUCACCAGCGACUAUGUCGUAUGGGUAAAGCGCUGCAUGUCUAAGACAGCAGAAGCAUCAAAG |
| 2114 | 45, 44 hairpin | UACUGGCGCUUUUAUCUCAUUACUUUGAGAGCCAUCACCAGCGACUAUGUCGUAUGGGUAAAGCGCAGGGCUUCGGCCGAAGCAUCAAAG |
| 2115 | U1A | UACUGGCGCUUUUAUCUCAUUACUUUGAGAGCCAUCACCAGCGACUAUGUCGUAUGGGUAAAGCGCAAUCCAUUGCACUCCGGAUUGAAGCAUCAAAG |
| 2116 | A14C, U17G | UACUGGCGCUUUUCUCGCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2117 | CUUCGG loop modified | UACUGGCGCUUUUAUCUCAUUACUUUGAGAGCCAUCACCAGCGACUAUGUCGUAUGGGUAAAGCGCUUAUUUAUCGGACUUCGGUCCGAUAAAUAAGAAGCAUCAAAG |
| 2118 | Kissing loop_b2 | UACUGGCGCUUUUAUCUCAUUACUUUGAGAGCCAUCACCAGCGACUAUGUCGUAUGGGUAAAGCGCUGCUCGUUUGCGGCUACGAGCAGAAGCAUCAAAG |
| 2119 | -76:78, -83:87 | UACUGGCGCUUUUAUCUCAUUACUUUGAGAGCCAUCACCAGCGACUAUGUCGUAUGGGUAAAGCGCUUAUUUAUCGAGAGAUAAAUAAGAAGCAUCAAAG |
| 2120 | -4 | UACGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2121 | extended stem truncation | UACUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2122 | C55 | UACUGGCGCUUUUAUCUCAUUACUUUGAGAGCCAUCACCAGCGACUAUGUCGUAUCGGUAAAGCGCUUAUUUAUCGGAGAGAAAUCCGAUAAAUAAGAAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2123 | trip mut | UACUGGCGCCUUUAUCUCAUUACUUUGAGAGCCAUCACCAGCGACUA UGUCGUAUGGGUAAAGCGCUUAUUUAUCGGACUUCGGUCCGAUAAAU AAGAAGCAUCAAAG |
| 2124 | -76:78 | UACUGGCGCUUUUAUCUCAUUACUUUGAGAGCCAUCACCAGCGACUA UGUCGUAUGGGUAAAGCGCUUAUUUAUCGAGAAAUCCGAUAAAUAAG AAGCAUCAAAG |
| 2125 | -1:5 | GCGCUUUUAUCUCAUUACUUUGAGAGCCAUCACCAGCGACUAUGUCG UAUGGGUAAAGCGCUUAUUUAUCGGAGAGAAAUCCGAUAAAUAAGAA GCAUCAAAG |
| 2126 | -83:87 | UACUGGCGCUUUUAUCUCAUUACUUUGAGAGCCAUCACCAGCGACUA UGUCGUAUGGGUAAAGCGCUUAUUUAUCGGAGAGAGAUAAAUAAGAA GCAUCAAAG |
| 2127 | =+G28, A82U, -84, | UACUGGCGCUUUUAUCUCAUUACUUUGGAGAGCCAUCACCAGCGACU AUGUCGUAUGGGUAAAGCGCUUAUUUAUCGGAGAGUAUCCGAUAAAU AAGAAGCAUCAAAG |
| 2128 | =+51U | UACUGGCGCUUUUAUCUCAUUACUUUGAGAGCCAUCACCAGCGACUA UGUUCGUAUGGGUAAAGCGCUUAUUUAUCGGAGAGAAAUCCGAUAAA UAAGAAGCAUCAAAG |
| 2129 | -1:4, +G5A, +G86, | AGCGCUUUUAUCUCAUUACUUUGAGAGCCAUCACCAGCGACUAUGUC GUAUGGGUAAAGCGCUUAUUUAUCGGAGAGAAAUGCCGAUAAAUAAG AAGCAUCAAAG |
| 2130 | =+A94 | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAA UAAGAAGCAUCAAAG |
| 2131 | =+G72 | UACUGGCGCUUUUAUCUCAUUACUUUGAGAGCCAUCACCAGCGACUA UGUCGUAUGGGUAAAGCGCUUAUUGUAUCGGAGAGAAAUCCGAUAAA UAAGAAGCAUCAAAG |
| 2132 | shorten front, CUUCGG loop modified. extend extended | GCGCUUUUAUCUCAUUACUUUGAGAGCCAUCACCAGCGACUAUGUCG UAUGGGUAAAGCGCUUAUUUAUCGGACUUCGGUCCGAUAAAUAAGCG CAUCAAAG |
| 2133 | A14C | UACUGGCGCUUUUCUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAG |
| 2134 | -1:3, +G3 | GUGGCGCUUUUAUCUCAUUACUUUGAGAGCCAUCACCAGCGACUAUG UCGUAUGGGUAAAGCGCUUAUUUAUCGGAGAGAAAUCCGAUAAAUAA GAAGCAUCAAAG |
| 2135 | =+C45, +U46 | UACUGGCGCUUUUAUCUCAUUACUUUGAGAGCCAUCACCAGCGACCU UAUGUCGUAUGGGUAAAGCGCUUAUUUAUCGGAGAGAAAUCCGAUAA AUAAGAAGCAUCAAAG |
| 2136 | CUUCGG loop modified, fun start | GAUGGCGCUUUUAUCUCAUUACUUUGAGAGCCAUCACCAGCGACUAU GUCGUAUGGGUAAAGCGCUUAUUUAUCGGACUUCGGUCCGAUAAAUA AGAAGCAUCAAAG |
| 2137 | -93:94 | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAA GAAGCAUCAAAG |
| 2138 | =+U45 | UACUGGCGCUUUUAUCUCAUUACUUUGAGAGCCAUCACCAGCGAUCU AUGUCGUAUGGGUAAAGCGCUUAUUUAUCGGAGAGAAAUCCGAUAAA UAAGAAGCAUCAAAG |
| 2139 | -69, -94 | UACUGGCGCUUUUAUCUCAUUACUUUGAGAGCCAUCACCAGCGACUA UGUCGUAUGGGUAAAGGCUUAUUUAUCGGAGAGAAAUCCGAUAAAA GAAGCAUCAAAG |
| 2140 | -94 | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAA AGAAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2141 | modified CUUCGG, minus U in 1st triplex | UACUGGCGCUUUUAUCUCAUUACUUUGAGAGCCAUCACCAGCGACUAU GUCGUAUGGGUAAAGCGCUUAUUUAUCGGACUUCGGUCCGAUAAAUA AGAAGCAUCAAAG |
| 2142 | -1:4, +C4, A14C, U17G, +G72, -76:78, -83:87 | CGGCGCUUUUCUCGCAUUACUUUGAGAGCCAUCACCAGCGACUAUGU CGUAUGGGUAAAGCGCUUAUUGUAUCGAGAGAUAAAUAAGAAGCAUC AAAG |
| 2143 | U1C, -73 | CACUGGCGCUUUUAUCUCAUUACUUUGAGAGCCAUCACCAGCGACUA UGUCGUAUGGGUAAAGCGCUUAUUUUCGGAGAGAAAUCCGAUAAAUA AGAAGCAUCAAAG |
| 2144 | Scaffold uuCG, stem uuCG. Stem swap, t shorten | UACUGGCGCUUUUAUCUCAUUACUUUGAGAGCCAUCACCAGCGACUUC GGUCGUAUGGGUAAAGCGCUUAUGUAUCGGCUUCGGCCGAUACAUAA GAAGCAUCAAAG |
| 2145 | Scaffold uuCG, stem uuCG. Stem swap | UACUGGCGCUUUUAUCUCAUUACUUUGAGAGCCAUCACCAGCGACUU CGGUCGUAUGGGUAAAGCGCUUAUGUAUCGGCUUCGGCCGAUACAUA AGAAGCAUCAAAG |
| 2146 | =+G60 | UACUGGCGCUUUUAUCUCAUUACUUUGAGAGCCAUCACCAGCGACUA UGUCGUAUGGGUGAAAGCGCUUAUUUAUCGGAGAGAAAUCCGAUAAA UAAGAAGCAUCAAAG |
| 2147 | no stem Scaffold uuCG | UACUGGCGCUUUUAUCUCAUUACUUUGAGAGCCAUCACCAGCGACUU CGGUCGUAUGGGUAAAG |
| 2148 | no stem Scaffold uuCG, fun start | GAUGGGCUUUUAUCUCAUUACUUUGAGAGCCAUCACCAGCGACUUCG GUCGUAUGGGUAAAG |
| 2149 | Scaffold uuCG, stem uuCG, fun start | GAUGGGCUUUUAUCUCAUUACUUUGAGAGCCAUCACCAGCGACUUCG GUCGUAUGGGUAAAGCGCUUAUUUAUCGGCUUCGGCCGAUAAAUAAG AAGCAUCAAAG |
| 2150 | Pseudoknots | UACUGGCGCUUUUAUCUCAUUACUUUGAGAGCCAUCACCAGCGACUA UGUCGUAUGGGUAAAGCGCUACACUGGGAUCGCUGAAUUAGAGAUCG GCGUCCUUUCAUUCUAUAUACUUUGGAGUUUUAAAAUGUCUCUAAGU ACAGAAGCAUCAAAG |
| 2151 | Scaffold uuCG, stem uuCG | GGCGCUUUUAUCUCAUUACUUUGAGAGCCAUCACCAGCGACUUCGGU CGUAUGGGUAAAGCGCUUAUUUAUCGGCUUCGGCCGAUAAAUAAGAA GCAUCAAAG |
| 2152 | Scaffold uuCG, stem uuCG, no start | GCUGGCGCUUUUAUCUCAUUACUUUGAGAGCCAUCACCAGCGACUUC GGUCGUAUGGGUAAAGCGCUUAUUUAUCGGCUUCGGCCGAUAAAUAA GAAGCAUCAAAG |
| 2153 | Scaffold uuCG | UACUGGCGCUUUUAUCUCAUUACUUUGAGAGCCAUCACCAGCGACUU CGGUCGUAUGGGUAAAGCGCUUAUUUAUCGGAGAGAAAUCCGAUAAA UAAGAAGCAUCAAAG |
| 2154 | =+GCUC36 | UACUGGCGCUUUUAUCUCAUUACUUUGAGAGCCAUGCUCCACCAGCG ACUAUGUCGUAUGGGUAAAGCGCUUAUUUAUCGGAGAGAAAUCCGAU AAAUAAGAAGCAUCAAAG |
| 2155 | G quadriplex telomere basket+ ends | UACUGGCGCUUUUAUCUCAUUACUUUGAGAGCCAUCACCAGCGACUA UGUCGUAUGGGUAAAGCGGGGUUAGGGUUAGGGUUAGGGAAGCAUCA AAG |
| 2156 | G quadriplex M3q | UACUGGCGCUUUUAUCUCAUUACUUUGAGAGCCAUCACCAGCGACUA UGUCGUAUGGGUAAAGCGGAGGGAGGGAGGGAGAGGGAAAGCAUCAA AG |

TABLE 2B-continued

Exemplary gNA Scaffold Sequences

| SEQ ID NO: | NAME or Modification | NUCLEOTIDE SEQUENCE |
|---|---|---|
| 2157 | G quadriplex telomere basket no ends | UACUGGCGCUUUUAUCUCAUUACUUUGAGAGCCAUCACCAGCGACUAUGUCGUAUGGGUAAAGCGUUGGGUUAGGGUUAGGGUUAGGGAAAAGCAUCAAAG |
| 2158 | 45, 44 hairpin (old version) | UACUGGCGCUUUUAUCUCAUUACUUUGAGAGCCAUCACCAGCGACUAUGUCGUAUGGGUAAAGCGC--------AGGGCUUCGGCCG---------GAAGCAUCAAAG |
| 2159 | Sarcin-ricin loop | UACUGGCGCUUUUAUCUCAUUACUUUGAGAGCCAUCACCAGCGACUAUGUCGUAUGGGUAAAGCGCCUGCUCAGUACGAGAGGAACCGCAGGAAGCAUCAAAG |
| 2160 | uvsX, C18G | UACUGGCGCUUUUAUCUGAUUACUUUGAGAGCCAUCACCAGCGACUAUGUCGUAUGGGUAAAGCGCCCUCUUCGGAGGGAAGCAUCAAAG |
| 2161 | truncated stem loop, C18G, trip mut (U10C) | UACUGGCGCCUUUAUCUGAUUACUUUGAGAGCCAUCACCAGCGACUAUGUCGUAUGGGUAAAGCGCUUACGGACUUCGGUCCGUAAGAAGCAUCAAAG |
| 2162 | short phage rep, C18G | UACUGGCGCUUUUAUCUGAUUACUUUGAGAGCCAUCACCAGCGACUAUGUCGUAUGGGUAAAGCGCGGACGACCUCUCGGUCGUCCGAAGCAUCAAAG |
| 2163 | phage rep loop, C18G | UACUGGCGCUUUUAUCUGAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2164 | =+G18, stacked onto 64 | UACUGGCGCCUUUAUCUGCAUUACUUUGAGAGCCAUCACCAGCGACUAUGUCGUAUGGGUAAAGCGCUUACGGACUUCGGUCCGUAAGAAGCAUCAG |
| 2165 | truncated stem loop, C18G, -1 A2G | GCUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2166 | phage rep loop, C18G, trip mut (U10C) | UACUGGCGCCUUUAUCUGAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2167 | short phage rep, C18G, trip mut (U10C) | UACUGGCGCCUUUAUCUGAUUACUUUGAGAGCCAUCACCAGCGACUAUGUCGUAUGGGUAAAGCGCGGACGACCUCUCGGUCGUCCGAAGCAUCAAAG |
| 2168 | uvsX, trip mut (U10C) | UACUGGCGCCUUUAUCUCAUUACUUUGAGAGCCAUCACCAGCGACUAUGUCGUAUGGGUAAAGCGCCCUCUUCGGAGGGAAGCAUCAAAG |
| 2169 | truncated stem loop | UACUGGCGCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2170 | =+A17, stacked onto 64 | UACUGGCGCCUUUAUCAUCAUUACUUUGAGAGCCAUCACCAGCGACUAUGUCGUAUGGGUAAAGCGCUUACGGACUUCGGUCCGUAAGAAGCAUCAG |
| 2171 | 3' HDV genomic ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGGGCCGGCAUGGUCCCAGCCUCCUCGCUGGCGCCGGCUGGGCAACAUUCCGAGGGGACCGUCCCCUCGGUAAUGGCGAAUGGGACCC |
| 2172 | phage rep loop, trip mut (U10C) | UACUGGCGCCUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2173 | -79:80 | UACUGGCGCUUUUAUCUCAUUACUUUGAGAGCCAUCACCAGCGACUAUGUCGUAUGGGUAAAGCGCUUAUUUAUCGGAGAAAUCCGAUAAAUAAGAAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2174 | short phage rep, trip mut (U10C) | UACUGGCGCCUUUUAUCUCAUUACUUUGAGAGCCAUCACCAGCGACUAUGUCGUAUGGGUAAAGCGCGGACGACCUCUCGGUCGUCCGAAGCAUCAAAG |
| 2175 | extra truncated stem loop | UACUGGCGCUUUUAUCUCAUUACUUUGAGAGCCAUCACCAGCGACUAUGUCGUAUGGGUAAAGCGCCGGACUUCGGUCCGGAAGCAUCAAAG |
| 2176 | U17G, C18G | UACUGGCGCUUUUAUCGGAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2177 | short phage rep | UACUGGCGCUUUUAUCUCAUUACUUUGAGAGCCAUCACCAGCGACUAUGUCGUAUGGGUAAAGCGCGGACGACCUCUCGGUCGUCCGAAGCAUCAAAG |
| 2178 | uvsX, C18G, -1 A2G | GCUGGCGCUUUUAUCUGAUUACUUUGAGAGCCAUCACCAGCGACUAUGUCGUAUGGGUAAAGCGCCCUCUUCGGAGGGAAGCAUCAAAG |
| 2179 | uvsX, C18G, trip mut (U10C), -1 A2G, HDV -99 G65U | GCUGGCGCUUUUAUCUGAUUACUUUGAGAGCCAUCACCAGCGACUAUGUCGUAUGGGUAAAGCUCCCUCUUCGGAGGGAGCAUCAAAG |
| 2180 | 3' HDV antigenomic ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGGGGUCGGCAUGGCAUCUCCACCUCCUCGCGGUCCGACCUGGGCAUCCGAAGGAGGACGCACGUCCACUCGGAUGGCUAAGGGAGAGCCA |
| 2181 | uvsX, C18G, trip mut (U10C), -1 A2G, HDV AA(98:99)C | GCUGGCGCUUUUAUCUGAUUACUUUGAGAGCCAUCACCAGCGACUAUGUCGUAUGGGUAAAGCGCCCUCUUCGGAGGGCGCAUCAAAG |
| 2182 | 3' HDV ribozyme (Lior Nissim, Timothy Lu) | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGUUUUGGCCGGCAUGGUCCCAGCCUCCUCGCUGGCGCCGGCUGGGCAACAUGCUUCGGCAUGGCGAAUGGGACCCCGGG |
| 2183 | TAC(1:3)GA, stacked onto 64 | GAUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2184 | uvsX, -1 A2G | GCUGGCGCUUUUAUCUCAUUACUUUGAGAGCCAUCACCAGCGACUAUGUCGUAUGGGUAAAGCGCCCUCUUCGGAGGGAAGCAUCAAAG |
| 2185 | truncated stem loop, C18G, trip mut (U10C), -1 A2G, HDV-99 G65U | GCUGGCGCCUUUAUCUGAUUACUUUGAGAGCCAUCACCAGCGACUAUGUCGUAUGGGUAAAGCUCUUACGGACUUCGGUCCGUAAGAGCAUCAAAG |
| 2186 | short phage rep, C18G, trip mut (U10C), -1 A2G, HDV -99 G65U | GCUGGCGCCUUUAUCUGAUUACUUUGAGAGCCAUCACCAGCGACUAUGUCGUAUGGGUAAAGCUCGGACGACCUCUCGGUCGUCCGAGCAUCAAAG |
| 2187 | 3' sTRSV WT viral Hammerhead ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCCUGUCACCGGAUGUGCUUUCCGGUCUGAUGAGUCCGUGAGGACGAAACAGG |
| 2188 | short phage rep, C18G, -1 A2G | GCUGGCGCUUUUAUCUGAUUACUUUGAGAGCCAUCACCAGCGACUAUGUCGUAUGGGUAAAGCGCGGACGACCUCUCGGUCGUCCGAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2189 | short phage rep, C18G, trip mut (U10C), -1 A2G, 3' genomic HDV | GCUGGCGCCUUUAUCUGAUUACUUUGAGAGCCAUCACCAGCGACUAU GUCGUAUGGGUAAAGCGCGGACGACCUCUCGGUCGUCCGAAGCAUCA AAG |
| 2190 | phage rep loop, C18G, trip mut (U10C), -1 A2G, HDV -99 G65U | GCUGGCGCCUUUAUCUGAUUACUUUGAGAGCCAUCACCAGCGACUAU GUCGUAUGGGUAAAGCUCAGGUGGGACGACCUCUCGGUCGUCCUAUC UGAGCAUCAAAG |
| 2191 | 3' HDV ribozyme (Owen Ryan, Jamie Cate) | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGGAUGGCCGGCAUGGUCCCAGCCUCCUCGCUGGC GCCGGCUGGGCAACACCUUCGGGUGGCGAAUGGGAC |
| 2192 | phage rep loop, C18G, -1 A2G | GCUGGCGCUUUUAUCUGAUUACUUUGAGAGCCAUCACCAGCGACUAU GUCGUAUGGGUAAAGCGCAGGUGGGACGACCUCUCGGUCGUCCUAUC UGAAGCAUCAAAG |
| 2193 | 0.14 | UACUGGCGCUUUUAUCUCAUUACUUUGAGAGCCAUCACCAGCGACUA UGUCGUACUGGGUAAAGCGCUUAUUUAUCGGAGAGAAAUCCGAUAAA UAAGAAGCAUCAAAG |
| 2194 | -78, G77U | UACUGGCGCUUUUAUCUCAUUACUUUGAGAGCCAUCACCAGCGACUA UGUCGUAUGGGUAAAGCGCUUAUUUAUCGUGAGAAAUCCGAUAAAUA AGAAGCAUCAAAG |
| 2195 | | GUACUGGCGCUUUUAUCUCAUUACUUUGAGAGCCAUCACCAGCGACU AUGUCGUAUGGGUAAAGCGCUUAUUUAUCGGAGAGAAAUCCGAUAAA UAAGAAGCAUCAAAG |
| 2196 | short phage rep, -1 A2G | GCUGGCGCUUUUAUCUCAUUACUUUGAGAGCCAUCACCAGCGACUAU GUCGUAUGGGUAAAGCGCGGACGACCUCUCGGUCGUCCGAAGCAUCA AAG |
| 2197 | truncated stem loop, C18G, trip mut (U10C), -1 A2G | GCUGGCGCCUUUAUCUGAUUACUUUGAGAGCCAUCACCAGCGACUAU GUCGUAUGGGUAAAGCGCUUACGGACUUCGGUCCGUAAGAAGCAUCA AAG |
| 2198 | -1, A2G | GCUGGCGCUUUUAUCUCAUUACUUUGAGAGCCAUCACCAGCGACUAU GUCGUAUGGGUAAAGCGCUUAUUUAUCGGAGAGAAAUCCGAUAAAUA AGAAGCAUCAAAG |
| 2199 | truncated stem loop, trip mut (U10C), -1 A2G | GCUGGCGCCUUUAUCUCAUUACUUUGAGAGCCAUCACCAGCGACUAU GUCGUAUGGGUAAAGCGCUUACGGACUUCGGUCCGUAAGAAGCAUCA AAG |
| 2200 | uvsX, C18G, trip mut (U10C), -1 A2G | GCUGGCGCCUUUAUCUGAUUACUUUGAGAGCCAUCACCAGCGACUAU GUCGUAUGGGUAAAGCGCCCUCUUCGGAGGGAAGCAUCAAAG |
| 2201 | phage rep loop, -1 A2G | GCUGGCGCUUUUAUCUCAUUACUUUGAGAGCCAUCACCAGCGACUAU GUCGUAUGGGUAAAGCGCAGGUGGGACGACCUCUCGGUCGUCCUAUC UGAAGCAUCAAAG |
| 2202 | phage rep loop, trip mut (U10C), -1 A2G | GCUGGCGCCUUUAUCUCAUUACUUUGAGAGCCAUCACCAGCGACUAU GUCGUAUGGGUAAAGCGCAGGUGGGACGACCUCUCGGUCGUCCUAUC UGAAGCAUCAAAG |
| 2203 | phage rep loop, C18G, trip mut (U10C), -1 A2G | GCUGGCGCCUUUAUCUGAUUACUUUGAGAGCCAUCACCAGCGACUAU GUCGUAUGGGUAAAGCGCAGGUGGGACGACCUCUCGGUCGUCCUAUC UGAAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2204 | truncated stem loop, C18G | UACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2205 | uvsX, trip mut (U10C), -1 A2G | GCUGGCGCCUUUAUCUCAUUACUUUGAGAGCCAUCACCAGCGACUAUGUCGUAUGGGUAAAGCGCCCUCUUCGGAGGGAAGCAUCAAAG |
| 2206 | truncated stem loop, -1 A2G | GCUGGCGCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2207 | short phage rep, trip mut (U10C), -1 A2G | GCUGGCGCCUUUAUCUCAUUACUUUGAGAGCCAUCACCAGCGACUAUGUCGUAUGGGUAAAGCGCGGACGACCUCUCGGUCGUCCGAAGCAUCAAG |
| 2208 | 5'HDV ribozyme (Owen Ryan, Jamie Cate) | GAUGGCCGGCAUGGUCCCAGCCUCCUCGCUGGCGCCGGCUGGGCAACACCUUCGGGUGGCGAAUGGGACUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2209 | 5'HDV genomic ribozyme | GGCCGGCAUGGUCCCAGCCUCCUCGCUGGCGCCGGCUGGGCAACAUUCCGAGGGGACCGUCCCCUCGGUAAUGGCGAAUGGGACCCUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2210 | truncated stem loop, C18G, trip mut (U10C), -1 A2G, HDV AA(98:99)C | GCUGGCGCUUUAUCUGAUUACUUUGAGAGCCAUCACCAGCGACUAUGUCGUAUGGGUAAAGCGCUUACGGACUUCGGUCCGUAAGCGCAUCAAG |
| 2211 | 5' env25 pistol ribozyme (with an added CUUCGG loop) | CGUGGUUAGGGCCACGUUAAAUAGUUGCUUAAGCCCUAAGCGUUGAUCUUCGGAUCAGGUGCAAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2212 | 5'HDV antigenomic ribozyme | GGGUCGGCAUGGCAUCUCCACCUCCUCGCGGUCCGACCUGGGCAUCCGAAGGAGGACGCACGUCCACUCGGAUGGCUAAGGGAGAGCCAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2213 | 3' Hammerhead ribozyme (Lior Nissim, Timothy Lu) guide scaffold scar | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCCAGUACUGAUGAGUCCGUGAGGAAACGACGAGUAAGCUCGUCUACUGGCGCUUUUAUCUCAU |
| 2214 | =+A27, stacked onto 64 | UACUGGCGCCUUUAUCUCAUUACUUUAGAGAGCCAUCACCAGCGACUAUGUCGUAUGGGUAAAGCGCUUACGGACUUCGGUCCGUAAGAAGCAUCAG |
| 2215 | 5'Hammerhead ribozyme (Li or Nissim, Timothy Lu) smaller scar | CGACUACUGAUGAGUCCGUGAGGACGAAACGAGUAAGCUCGUCUAGUCGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2216 | phage rep loop, C18G, trip mut (U10C), -1 A2G, HDV AA(98:99)C | GCUGGCGCCUUUAUCUGAUUACUUUGAGAGCCAUCACCAGCGACUAUGUCGUAUGGGUAAAGCGCAGGUGGGACGACCUCUCGGUCGUCCUAUCUGCGCAUCAAAG |

TABLE 2B-continued

Exemplary gNA Scaffold Sequences

| SEQ ID NO: | NAME or Modification | NUCLEOTIDE SEQUENCE |
|---|---|---|
| 2217 | -27, stacked onto 64 | UACUGGCGCCUUUAUCUCAUUACUUUAGAGCCAUCACCAGCGACUAU GUCGUAUGGGUAAAGCGCUUACGGACUUCGGUCCGUAAGAAGCAUCA AAG |
| 2218 | 3' Hatchet | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGCAUUCCUCAGAAAAUGACAAACCUGUGGGGCGU AAGUAGAUCUUCGGAUCUAUGAUCGUGCAGACGUUAAAAUCAGGU |
| 2219 | 3' Hammerhead ribozyme (Lior Nissim, Timothy Lu) | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGCGACUACUGAUGAGUCCGUGAGGACGAAACGAG UAAGCUCGUCUAGUCGCGUGUAGCGAAGCA |
| 2220 | 5' Hatchet | CAUUCCUCAGAAAAUGACAAACCUGUGGGGCGUAAGUAGAUCUUCGG AUCUAUGAUCGUGCAGACGUUAAAAUCAGGUUACUGGCGCUUUUAUC UCAUUACUUUGAGAGCCAUCACCAGCGACUAUGUCGUAUGGGUAAAG CGCUUAUUUAUCGGAGAGAAAUCCGAUAAAUAAGAAGCAUCAAAG |
| 2221 | 5' HDV ribozyme (Lior Nissim, Timothy Lu) | UUUUGGCCGGCAUGGUCCCAGCCUCCUCGCUGGCGCCGGCUGGGCAA CAUGCUUCGGCAUGGCGAAUGGGACCCCGGGUACUGGCGCUUUUAUC UCAUUACUUUGAGAGCCAUCACCAGCGACUAUGUCGUAUGGGUAAAG CGCUUAUUUAUCGGAGAGAAAUCCGAUAAAUAAGAAGCAUCAAAG |
| 2222 | 5' Hammerhead ribozyme (Lior Nissim, Timothy Lu) | CGACUACUGAUGAGUCCGUGAGGACGAAACGAGUAAGCUCGUCUAGU CGCGUGUAGCGAAGCAUACUGGCGCUUUUAUCUCAUUACUUUGAGAG CCAUCACCAGCGACUAUGUCGUAUGGGUAAAGCGCUUAUUUAUCGGA GAGAAAUCCGAUAAAUAAGAAGCAUCAAAG |
| 2223 | 3' HH15 Minimal Hammerhead ribozyme | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGGGGAGCCCCGCUGAUGAGGUCGGGGAGACCGAA AGGGACUUCGGUCCCUACGGGGCUCCC |
| 2224 | 5' RBMX recruiting motif | CCACCCCCACCACCACCCCCACCCCCACCACCACCCUACUGGCGCUU UUAUCUCAUUACUUUGAGAGCCAUCACCAGCGACUAUGUCGUAUGGG UAAAGCGCUUAUUUAUCGGAGAGAAAUCCGAUAAAUAAGAAGCAUCA AAG |
| 2225 | 3' Hammerhead ribozyme (Lior Nissim, Timothy Lu) smaller scar | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGCGACUACUGAUGAGUCCGUGAGGACGAAACGAG UAAGCUCGUCUAGUCG |
| 2226 | 3' env25 pistol ribozyme (with an added CUUCGG loop) | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGCGUGGUUAGGGCCACGUUUAAAUAGUUGCUUAAG CCCUAAGCGUUGAUCUUCGGAUCAGGUGCAA |
| 2227 | 3' Env-9 Twister | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGGGCAAUAAAGCGGUUACAAGCCCGCAAAAAUAG CAGAGUAAUGUCGCGAUAGCGCGGCAUUAAUGCAGCUUUAUUG |
| 2228 | =+AUUAUC UCAUUACU 25 | UACUGGCGCUUUUAUCUCAUUACUAUUAUCUCAUUACUUUGAGAGCC AUCACCAGCGACUAUGUCGUAUGGGUAAAGCGCUUAUUUAUCGGAGA GAAAUCCGAUAAAUAAGAAGCAUCAAAG |
| 2229 | 5' Env-9 Twister | GGCAAUAAAGCGGUUACAAGCCCGCAAAAAUAGCAGAGUAAUGUCGC GAUAGCGCGGCAUUAAUGCAGCUUUAUUGUACUGGCGCUUUUAUCUC AUUACUUUGAGAGCCAUCACCAGCGACUAUGUCGUAUGGGUAAAGCG CUUAUUUAUCGGAGAGAAAUCCGAUAAAUAAGAAGCAUCAAAG |
| 2230 | 3' Twisted Sister 1 | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGACCCGCAAGGCCGACGGCAUCCGCCGCCGCUGG UGCAAGUCCAGCCGCCCCUUCGGGGGCGGGCGCUCAUGGGUAAC |

TABLE 2B-continued

Exemplary gNA Scaffold Sequences

| SEQ ID NO: | NAME or Modification | NUCLEOTIDE SEQUENCE |
|---|---|---|
| 2231 | no stem | UACUGGCGCUUUUAUCUCAUUACUUUGAGAGCCAUCACCAGCGACUAUGUCGUAUGGGUAAAG |
| 2232 | 5' HH15 Minimal Hammerhead ribozyme | GGGAGCCCCGCUGAUGAGGUCGGGGAGACCGAAAGGGACUUCGGUCCCUACGGGGCUCCCUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2233 | 5' Hammerhead ribozyme (Li or Nissim, Timothy Lu) guide scaffold scar | CCAGUACUGAUGAGUCCGUGAGGACGAAACGAGUAAGCUCGUCUACUGGCGCUUUUAUCUCAUUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2234 | 5' Twisted Sister 1 | ACCCGCAAGGCCGACGGCAUCCGCCGCCGCUGGUGCAAGUCCAGCCGCCCCUUCGGGGGCGGGCGCUCAUGGGUAACUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2235 | 5' sTRSV WT viral Hammerhead ribozyme | CCUGUCACCGGAUGUGCUUUCCGGUCUGAUGAGUCCGUGAGGACGAAACAGGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2236 | 148: =+G55, stacked onto 64 | GUACUGGCGCCUUUUAUCUCAUUACUUUGAGAGCCAUCACCAGCGACUAUGUCGUAGUGGGUAAAGCGCUUACGGACUUCGGUCCGUAAGAAGCAUCAAAG |
| 2237 | 158: 103+148(+G55) -99, G65U | GUACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2238 | 174: Uvsx Extended stem with [A99] G65U), C18G, ^G55, [GU-1] | ACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2239 | 175: extended stem truncation, U10C, [GU-1] | ACUGGCGCCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2240 | 176: 174 with A1G substitution for T7 transcription | GCUGGCGCUUUUAUCUGAUUACUUUGAGAGCCAUCACCAGCGACUAUGUCGUAGUGGGUAAAGCUCCCUCUUCGGAGGGAGCAUCAAAG |
| 2241 | 177: 174 with bubble (+G55) removed | ACUGGCGCUUUUAUCUGAUUACUUUGAGAGCCAUCACCAGCGACUAUGUCGUAUGGGUAAAGCUCCCUCUUCGGAGGGAGCAUCAAAG |
| 2242 | 181: stem 42 (truncated stem loop); U10C, C18G, [GU-1] (95+[GU-1]) | ACUGGCGCCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2243 | 182: stem 42 (truncated stem loop); C18G, [GU-1] | ACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2244 | 183: stem 42 (truncated stem loop); C18G, ^G55, [GU-1] | ACUGGCGCUUUUAUCUGAUUACUUUGAGAGCCAUCACCAGCGACUAUGUCGUAGUGGGUAAAGCGCUUACGGACUUCGGUCCGUAAGAAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2245 | 184: stem 48 (uvsx, -99 g65t); C18G, ^T55, [GU-1] | ACUGGCGCUUUUAUCUGAUUACUUUGAGAGCCAUCACCAGCGACUAU GUCGUAUUGGGUAAAGCUCCCUCUUCGGAGGGAGCAUCAAAG |
| 2246 | 185: stem 42 (truncated stem loop); C18G, ^U55, [GU-1] | ACUGGCGCUUUUAUCUGAUUACUUUGAGAGCCAUCACCAGCGACUAU GUCGUAUUGGGUAAAGCGCUUACGGACUUCGGUCCGUAAGAAGCAUC AAAG |
| 2247 | 186: stem 42 (truncated stem loop); U10C, ^A17, [GU-1] | ACUGGCGCCUUUAUCAUCAUUACUUUGAGAGCCAUCACCAGCGACUA UGUCGUAUGGGUAAAGCGCUUACGGACUUCGGUCCGUAAGAAGCAUC AAAG |
| 2248 | 187: stem 46 (uvsx); C18G, ^G55, [GU-1] | ACUGGCGCUUUUAUCUGAUUACUUUGAGAGCCAUCACCAGCGACUAU GUCGUAGUGGGUAAAGCGCCCUCUUCGGAGGGAAGCAUCAAAG |
| 2249 | 188: stem 50 (m52 U15C, -99, g65t); C18G, ^G55, [GU-1] | ACUGGCGCUUUUAUCUGAUUACUUUGAGAGCCAUCACCAGCGACUAU GUCGUAGUGGGUAAAGCUCACAUGAGGAUCACCCAUGUGAGCAUCAA AG |
| 2250 | 189: 174 + G8A; U15C; U35A | ACUGGCACUUUUACCUGAUUACUUUGAGAGCCAACACCAGCGACUAU GUCGUAGUGGGUAAAGCUCCCUCUUCGGAGGGAGCAUCAAAG |
| 2251 | 190: 174 + G8A | ACUGGCACUUUUAUCUGAUUACUUUGAGAGCCAUCACCAGCGACUAU GUCGUAGUGGGUAAAGCUCCCUCUUCGGAGGGAGCAUCAAAG |
| 2252 | 191: 174 + G8C | ACUGGCCCUUUUAUCUGAUUACUUUGAGAGCCAUCACCAGCGACUAU GUCGUAGUGGGUAAAGCUCCCUCUUCGGAGGGAGCAUCAAAG |
| 2253 | 192: 174 + U15C | ACUGGCGCUUUUACCUGAUUACUUUGAGAGCCAUCACCAGCGACUAU GUCGUAGUGGGUAAAGCUCCCUCUUCGGAGGGAGCAUCAAAG |
| 2254 | 193, 174 + U35A | ACUGGCGCUUUUAUCUGAUUACUUUGAGAGCCAACACCAGCGACUAU GUCGUAGUGGGUAAAGCUCCCUCUUCGGAGGGAGCAUCAAAG |
| 2255 | 195: 175 + C18G + G8A; U15C; U35A | ACUGGCACCUUUACCUGAUUACUUUGAGAGCCAACACCAGCGACUAU GUCGUAUGGGUAAAGCGCUUACGGACUUCGGUCCGUAAGAAGCAUCA AAG |
| 2256 | 196: 175 + C18G + G8A | ACUGGCACCUUUAUCUGAUUACUUUGAGAGCCAUCACCAGCGACUAU GUCGUAUGGGUAAAGCGCUUACGGACUUCGGUCCGUAAGAAGCAUCA AAG |
| 2257 | 197: 175 + C18G + G8C | ACUGGCCCUUUUAUCUGAUUACUUUGAGAGCCAUCACCAGCGACUAU GUCGUAUGGGUAAAGCGCUUACGGACUUCGGUCCGUAAGAAGCAUCA AAG |
| 2258 | 198: 175 + C18G + U35A | ACUGGCGCCUUUAUCUGAUUACUUUGAGAGCCAACACCAGCGACUAU GUCGUAUGGGUAAAGCGCUUACGGACUUCGGUCCGUAAGAAGCAUCA AAG |
| 2259 | 199: 174 + A2G (test G transcription at start; ccGCT...) | GCUGGCGCUUUUAUCUGAUUACUUUGAGAGCCAUCACCAGCGACUAU GUCGUAGUGGGUAAAGCUCCCUCUUCGGAGGGAGCAUCAAAG |
| 2260 | 200: 174 + ^G1 (ccGACU...) | GACUGGCGCUUUUAUCUGAUUACUUUGAGAGCCAUCACCAGCGACUA UGUCGUAGUGGGUAAAGCUCCCUCUUCGGAGGGAGCAUCAAAG |

TABLE 2B-continued

Exemplary gNA Scaffold Sequences

| SEQ ID NO: | NAME or Modification | NUCLEOTIDE SEQUENCE |
|---|---|---|
| 2261 | 201: 174 + U10C; AG28 | ACUGGCGCCUUUAUCUGAUUACUUUGGAGAGCCAUCACCAGCGACUAUGUCGUAGUGGGUAAAGCUCCCUCUUCGGAGGGAGCAUCAAAG |
| 2262 | 202: 174 + U10A; A28U | ACUGGCGCAUUUAUCUGAUUACUUUGUGAGCCAUCACCAGCGACUAUGUCGUAGUGGGUAAAGCUCCCUCUUCGGAGGGAGCAUCAAAG |
| 2263 | 203: 174 + U10C | ACUGGCGCCUUUAUCUGAUUACUUUGAGAGCCAUCACCAGCGACUAUGUCGUAGUGGGUAAAGCUCCCUCUUCGGAGGGAGCAUCAAAG |
| 2264 | 204: 174 + ^G28 | ACUGGCGCUUUUAUCUGAUUACUUUGGAGAGCCAUCACCAGCGACUAUGUCGUAGUGGGUAAAGCUCCCUCUUCGGAGGGAGCAUCAAAG |
| 2265 | 205: 174 + U10A | ACUGGCGCAUUUAUCUGAUUACUUUGAGAGCCAUCACCAGCGACUAUGUCGUAGUGGGUAAAGCUCCCUCUUCGGAGGGAGCAUCAAAG |
| 2266 | 206, 174 + A28U | ACUGGCGCUUUUAUCUGAUUACUUUGUGAGCCAUCACCAGCGACUAUGUCGUAGUGGGUAAAGCUCCCUCUUCGGAGGGAGCAUCAAAG |
| 2267 | 207: 174 + ^U15 | ACUGGCGCUUUUAUUCUGAUUACUUUGAGAGCCAUCACCAGCGACUAUGUCGUAGUGGGUAAAGCUCCCUCUUCGGAGGGAGCAUCAAAG |
| 2268 | 208: 174 + [U4] | ACGGCGCUUUUAUCUGAUUACUUUGAGAGCCAUCACCAGCGACUAUGUCGUAGUGGGUAAAGCUCCCUCUUCGGAGGGAGCAUCAAAG |
| 2269 | 209: 174 + C16A | ACUGGCGCUUUUAUAUGAUUACUUUGAGAGCCAUCACCAGCGACUAUGUCGUAGUGGGUAAAGCUCCCUCUUCGGAGGGAGCAUCAAAG |
| 2270 | 210: 174 + ^U17 | ACUGGCGCUUUUAUCUUGAUUACUUUGAGAGCCAUCACCAGCGACUAUGUCGUAGUGGGUAAAGCUCCCUCUUCGGAGGGAGCAUCAAAG |
| 2271 | 211: 174 + U35G (compare with 174 + U35A above) | ACUGGCGCUUUUAUCUGAUUACUUUGAGAGCCAGCACCAGCGACUAUGUCGUAGUGGGUAAAGCUCCCUCUUCGGAGGGAGCAUCAAAG |
| 2272 | 212: 174 + U11G, A105G (A86G), U26C | ACUGGCGCUGUUAUCUGAUUACUUCGAGAGCCAUCACCAGCGACUAUGUCGUAGUGGGUAAAGCUCCCUCUUCGGAGGGAGCAUCGAAG |
| 2273 | 213: 174 + U11C, A105G (A86G), U26C | ACUGGCGCUCUUAUCUGAUUACUUCGAGAGCCAUCACCAGCGACUAUGUCGUAGUGGGUAAAGCUCCCUCUUCGGAGGGAGCAUCGAAG |
| 2274 | 214: 174 + U12G; A106G (A87G), U25C | ACUGGCGCUUGUAUCUGAUUACUCUGAGAGCCAUCACCAGCGACUAUGUCGUAGUGGGUAAAGCUCCCUCUUCGGAGGGAGCAUCAGAG |
| 2275 | 215: 174 + U12C; A106G (A87G), U25C | ACUGGCGCUUCUAUCUGAUUACUCUGAGAGCCAUCACCAGCGACUAUGUCGUAGUGGGUAAAGCUCCCUCUUCGGAGGGAGCAUCAGAG |
| 2276 | 216: 174_tx_11.G, 87.G, 22.0 | ACUGGCGCUUUGAUCUGAUUACCUUGAGAGCCAUCACCAGCGACUAUGUCGUAGUGGGUAAAGCUCCCUCUUCGGAGGGAGCAUCAAGG |
| 2277 | 217: 174_tx_11.C, 87.G, 22.0 | ACUGGCGCUUUCAUCUGAUUACCUUGAGAGCCAUCACCAGCGACUAUGUCGUAGUGGGUAAAGCUCCCUCUUCGGAGGGAGCAUCAAGG |
| 2278 | 218: 174 + U11G | ACUGGCGCUGUUAUCUGAUUACUUUGAGAGCCAUCACCAGCGACUAUGUCGUAGUGGGUAAAGCUCCCUCUUCGGAGGGAGCAUCAAAG |
| 2279 | 219: 174 + A105G (A86G) | ACUGGCGCUUUUAUCUGAUUACUUUGAGAGCCAUCACCAGCGACUAUGUCGUAGUGGGUAAAGCUCCCUCUUCGGAGGGAGCAUCGAAG |

TABLE 2B-continued

Exemplary gNA Scaffold Sequences

| SEQ ID NO: | NAME or Modification | NUCLEOTIDE SEQUENCE |
|---|---|---|
| 2280 | 220: 174 + U26C | ACUGGCGCUUUUAUCUGAUUACUUCGAGAGCCAUCACCAGCGACUAU GUCGUAGUGGGUAAAGCUCCCUCUUCGGAGGGAGCAUCAAAG |

In some embodiments, the gNA variant comprises a tracrRNA stem loop comprising the sequence -UUU-N4-25-UUU-(SEQ ID NO: 21). For example, the gNA variant comprises a scaffold stem loop or a replacement thereof, flanked by two triplet U motifs that contribute to the triplex region. In some embodiments, the scaffold stem loop or replacement thereof comprises at least 4 nucleotides, at least 5 nucleotides, at least 6 nucleotides, at least 7 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides.

In some embodiments, the gNA variant comprises a crRNA sequence with -AAAG-in a location 5' to the spacer region. In some embodiments, the -AAAG- sequence is immediately 5' to the spacer region.

In some embodiments, the at least one nucleotide modification to a reference gNA to produce a gNA variant comprises at least one nucleotide deletion in the CasX variant gNA relative to the reference gRNA. In some embodiments, a gNA variant comprises a deletion of 1, 2, 3, 4, 5, 6, 7, 8, 9, 10, 11, 12, 13, 14, 15, 16, 17, 18, 19 or 20 consecutive or non-consecutive nucleotides relative to a reference gNA. In some embodiments, the at least one deletion comprises a deletion of 1, 2, 3, 4, 5, 6, 7, 8, 9, 10, 11, 12, 13, 14, 15, 16, 17, 18, 19 or 20 or more consecutive nucleotides relative to a reference gNA. In some embodiments, the gNA variant comprises 2, 3, 4, 5, 6, 7, 8, 9, 10, 11, 12, 13, 14, 15, 16, 17, 18, 19 or 20 or more nucleotide deletions relative to the reference gNA, and the deletions are not in consecutive nucleotides. In those embodiments where there are two or more non-consecutive deletions in the gNA variant relative to the reference gRNA, any length of deletions, and any combination of lengths of deletions, as described herein, are contemplated as within the scope of the disclosure. For example, in some embodiments, a gNA variant may comprise a first deletion of one nucleotide, and a second deletion of two nucleotides and the two deletions are not consecutive. In some embodiments, a gNA variant comprises at least two deletions in different regions of the reference gRNA. In some embodiments, a gNA variant comprises at least two deletions in the same region of the reference gRNA. For example, the regions may be the extended stem loop, scaffold stem loop, scaffold stem bubble, triplex loop, pseudoknot, triplex, or a 5' end of the gNA variant. The deletion of any nucleotide in a reference gRNA is contemplated as within the scope of the disclosure.

In some embodiments, the at least one nucleotide modification of a reference gRNA to generate a gNA variant comprises at least one nucleotide insertion. In some embodiments, a gNA variant comprises an insertion of 1, 2, 3, 4, 5, 6, 7, 8, 9 or 10 consecutive or non-consecutive nucleotides relative to a reference gRNA. In some embodiments, the at least one nucleotide insertion comprises an insertion of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more insertions relative to the reference gRNA, and the insertions are not consecutive. In those embodiments where there are two or more non-consecutive insertions in the gNA variant relative to the reference gRNA, any length of insertions, and any combination of lengths of insertions, as described herein, are contemplated as within the scope of the disclosure. For example, in some embodiments, a gNA variant may comprise a first insertion of one nucleotide, and a second insertion of two nucleotides and the two insertions are not consecutive. In some embodiments, a gNA variant comprises at least two insertions in different regions of the reference gRNA. In some embodiments, a gNA variant comprises at least two insertions in the same region of the reference gRNA. For example, the regions may be the extended stem loop, scaffold stem loop, scaffold stem bubble, triplex loop, pseudoknot, triplex, or a 5' end of the gNA variant. Any insertion of A, G, C, U (or T, in the corresponding DNA) or combinations thereof at any location in the reference gRNA is contemplated as within the scope of the disclosure.

In some embodiments, the at least one nucleotide modification of a reference gRNA to generate a gNA variant comprises at least one nucleic acid substitution. In some embodiments, a gNA variant comprises 1, 2, 3, 4, 5, 6, 7, 8, 9, 10, 11, 12, 13, 14, 15, 16, 17, 18, 19 or 20 or more consecutive or non-consecutive substituted nucleotides relative to a reference gRNA. In some embodiments, a gNA variant comprises 1-4 nucleotide substitutions relative to a reference gRNA. In some embodiments, the at least one substitution comprises a substitution of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more substitutions relative to the reference gRNA, and the substitutions are not consecutive. In those embodiments where there are two or more non-consecutive substitutions in the gNA variant relative to the reference gRNA, any length of substituted nucleotides, and any combination of lengths of substituted nucleotides, as described herein, are contemplated as within the scope of the disclosure. For example, in some embodiments, a gNA variant may comprise a first substitution of one nucleotide, and a second substitution of two nucleotides and the two substitutions are not consecutive. In some embodiments, a gNA variant comprises at least two substitutions in different regions of the reference gRNA. In some embodiments, a gNA variant comprises at least two substitutions in the same region of the reference gRNA. For example, the regions may be the triplex, the extended stem loop, scaffold stem loop, scaffold stem bubble, triplex loop, pseudoknot, triplex, or a 5' end of the gNA variant. Any substitution of A, G, C, U (or T, in the corresponding DNA) or combinations thereof at any location in the reference gRNA is contemplated as within the scope of the disclosure.

Any of the substitutions, insertions and deletions described herein can be combined to generate a gNA variant of the disclosure. For example, a gNA variant can comprise at least one substitution and at least one deletion relative to a reference gRNA, at least one substitution and at least one insertion relative to a reference gRNA, at least one insertion and at least one deletion relative to a reference gRNA, or at least one substitution, one insertion and one deletion relative to a reference gRNA.

In some embodiments, the gNA variant comprises a scaffold region at least 20% identical, at least 30% identical, at least 40% identical, at least 50% identical, at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to any one of SEQ ID NOS: 4-16. In some embodiments, the gNA variant comprises a scaffold region at least 60% homologous (or identical) to any one of SEQ ID NOS: 4-16.

In some embodiments, the gNA variant comprises a tracr stem loop at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to SEQ ID NO: 14. In some embodiments, the gNA variant comprises a tracr stem loop at least 60% homologous (or identical) to SEQ ID NO: 14.

In some embodiments, the gNA variant comprises an extended stem loop at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to SEQ ID NO: 15. In some embodiments, the gNA variant comprises an extended stem loop at least 60% homologous (or identical) to SEQ ID NO: 15.

In some embodiments, the gNA variant comprises an exogenous extended stem loop, with such differences from a reference gNA described as follows. In some embodiments, an exogenous extended stem loop has little or no identity to the reference stem loop regions disclosed herein (e.g., SEQ ID NO: 15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, at least 500 bp, at least 600 bp, at least 700 bp, at least 800 bp, at least 900 bp, at least 1,000 bp, at least 2,000 bp, at least 3,000 bp, at least 4,000 bp, at least 5,000 bp, at least 6,000 bp, at least 7,000 bp, at least 8,000 bp, at least 9,000 bp, at least 10,000 bp, at least 12,000 bp, at least 15,000 bp or at least 20,000 bp. In some embodiments, the gNA variant comprises an extended stem loop region comprising at least 10, at least 100, at least 500, at least 1000, or at least 10,000 nucleotides. In some embodiments, the heterologous stem loop increases the stability of the gNA. In some embodiments, the heterologous RNA stem loop is capable of binding a protein, an RNA structure, a DNA sequence, or a small molecule. In some embodiments, an exogenous stem loop region comprises an RNA stem loop or hairpin, for example a thermostable RNA such as MS2 (ACAUGAGGAUUACCCAUGU; SEQ ID NO: 22), Qβ (UGCAUGUCUAAGACAGCA; SEQ ID NO: 23), U1 hairpin II (AAUCCAUUGCACUCCGGAUU; SEQ ID NO: 24), Uvsx (CCUCUUCGGAGG; SEQ ID NO: 25), PP7 (AGGAGUUUCUAUGGAAACCCU; SEQ ID NO: 26), Phage replication loop (AGGUGGGACGACCU-CUCGGUCGUCCUAUCU; SEQ ID NO: 27), Kissing loop_a (UGCUCGCUCCGUUCGAGCA; SEQ ID NO: 28), Kissing loop_b1 (UGCUCGACGCGUCCUCGAGCA; SEQ ID NO: 29), Kissing loop_b2 (UG-CUCGUUUGCGGCUACGAGCA; SEQ ID NO: 30), G quadriplex M3q (AGGGAGGGAGGGAGAGG; SEQ ID NO: 31), G quadriplex telomere basket (GGUUAGG-GUUAGGGUUAGG; SEQ ID NO: 32), Sarcin-ricin loop (CUGCUCAGUACGAGAGGAACCGCAG; SEQ ID NO: 33) or Pseudoknots (UACACUGGGAUCGCUGAAUUA-GAGAUCGGCGUCCUUUCAUUCUAUAUACUUU GGAGUUUUAAAAUGUCUCUAAGUACA; SEQ ID NO: 34). In some embodiments, an exogenous stem loop comprises an RNA scaffold. As used herein, an "RNA scaffold" refers to a multi-dimensional RNA structure capable of interacting with and organizing or localizing one or more proteins. In some embodiments, the RNA scaffold is synthetic or non-naturally occurring. In some embodiments, an exogenous stem loop comprises a long non-coding RNA (lncRNA). As used herein, a lncRNA refers to a non-coding RNA that is longer than approximately 200 bp in length. In some embodiments, the 5' and 3' ends of the exogenous stem loop are base paired, i.e., interact to form a region of duplex RNA. In some embodiments, the 5' and 3' ends of the exogenous stem loop are base paired, and one or more regions between the 5' and 3' ends of the exogenous stem loop are not base paired. In some embodiments, the at least one nucleotide modification comprises: (a) substitution of 1 to 15 consecutive or non-consecutive nucleotides in the gNA variant in one or more regions; (b) a deletion of 1 to 10 consecutive or non-consecutive nucleotides in the gNA variant in one or more regions; (c) an insertion of 1 to 10 consecutive or non-consecutive nucleotides in the gNA variant in one or more regions; (d) a substitution of the scaffold stem loop or the extended stem loop with an RNA stem loop sequence from a heterologous RNA source with proximal 5' and 3' ends; or any combination of (a)-(d).

In some embodiments, the gNA variant comprises a scaffold stem loop having at least 60% identity to SEQ ID NO: 14. In some embodiments, the gNA variant comprises a scaffold stem loop having at least 60% identity, at least 70% identity, at least 80% identity, at least 90% identity, at least 95% identity, at least 98% identity or at least 99% identity to SEQ ID NO: 14. In some embodiments, the gNA variant comprises a scaffold stem loop comprising SEQ ID NO: 14.

In some embodiments, the gNA variant comprises a scaffold stem loop sequence of CCAGCGACUAUGU-CGUAGUGG (SEQ ID NO: 20). In some embodiments, the gNA variant comprises a scaffold stem loop sequence of CCAGCGACUAUGUCGUAGUGG (SEQ ID NO: 20) with at least 1, 2, 3, 4, or 5 mismatches thereto.

In some embodiments, the gNA variant comprises an extended stem loop region comprising less than 32 nucleotides, less than 31 nucleotides, less than 30 nucleotides, less than 29 nucleotides, less than 28 nucleotides, less than 27 nucleotides, less than 26 nucleotides, less than 25 nucleotides, less than 24 nucleotides, less than 23 nucleotides, less than 22 nucleotides, less than 21 nucleotides, or less than 20 nucleotides. In some embodiments, the gNA variant comprises an extended stem loop region comprising less than 32 nucleotides. In some embodiments, the gNA variant further comprises a thermostable stem loop.

In some embodiments, a sgRNA variant comprises a sequence of SEQ ID NO: 2104, SEQ ID NO: 2106, SEQ ID NO: 2163, SEQ ID NO: 2107, SEQ ID NO: 2164, SEQ ID NO: 2165, SEQ ID NO: 2166, SEQ ID NO: 2103, SEQ ID NO: 2167, SEQ ID NO: 2105, SEQ ID NO: 2108, SEQ ID NO: 2112, SEQ ID NO: 2160, SEQ ID NO: 2170, SEQ ID NO: 2114, SEQ ID NO: 2171, SEQ ID NO: 2112, SEQ ID NO: 2173, SEQ ID NO: 2102, SEQ ID NO: 2174, SEQ ID NO: 2175, SEQ ID NO: 2109, SEQ ID NO: 2176, SEQ ID NO: 2238, SEQ ID NO: 2239, SEQ ID NO: 2240, SEQ ID NO: 2241, SEQ ID NO: 2274, or SEQ ID NO: 2275.

In some embodiments, the gNA variant comprises the sequence of any one of SEQ ID NOS: 2236, 2237, 2238, 2241, 2244, 2248, 2249, or 2259-2280, or having at least about 80%, at least about 90%, at least about 95%, at least about 96%, at least about 97%, at least about 98%, at least about 99% identity thereto. In some embodiments, the gNA variant comprises one or more additional changes to a sequence of any one of SEQ ID NOs: 2201-2280. In some embodiments, the gNA variant comprises the sequence of any one of SEQ ID NOS: 2236, 2237, 2238, 2241, 2244, 2248, 2249, or 2259-2280.

In some embodiments, a sgRNA variant comprises one or more additional changes to a sequence of SEQ ID NO: 2104, SEQ ID NO: 2163, SEQ ID NO: 2107, SEQ ID NO: 2164, SEQ ID NO: 2165, SEQ ID NO: 2166, SEQ ID NO: 2103, SEQ ID NO: 2167, SEQ ID NO: 2105, SEQ ID NO: 2108, SEQ ID NO: 2112, SEQ ID NO: 2160, SEQ ID NO: 2170, SEQ ID NO: 2114, SEQ ID NO: 2171, SEQ ID NO: 2112, SEQ ID NO: 2173, SEQ ID NO: 2102, SEQ ID NO: 2174, SEQ ID NO: 2175, SEQ ID NO: 2109, SEQ ID NO: 2176, SEQ ID NO: 2238, SEQ ID NO: 2239, SEQ ID NO: 2240, SEQ ID NO: 2241, SEQ ID NO: 2274, or SEQ ID NO: 2275.

In some embodiments of the gNA variants of the disclosure, the gNA variant comprises at least one modification, wherein the at least one modification compared to the reference guide scaffold of SEQ ID NO: 5 is selected from one or more of: (a) a C18G substitution in the triplex loop; (b) a G55 insertion in the stem bubble; (c) a U1 deletion; (d) a modification of the extended stem loop wherein (i) a 6 nt loop and 13 loop-proximal base pairs are replaced by a Uvsx hairpin; and (ii) a deletion of A99 and a substitution of G65U that results in a loop-distal base that is fully base-paired. In such embodiments, the gNA variant comprises the sequence of any one of SEQ ID NOS: 2236, 2237, 2238, 2241, 2244, 2248, 2249, or 2259-2280.

In some embodiments, the scaffold of the gNA variant comprises the sequence of any one of SEQ ID NOS: 2201-2280 of Table 2B. In some embodiments, the scaffold of the gNA consists or consists essentially of the sequence of any one of SEQ ID NOS: 2201-2280. In some embodiments, the scaffold of the gNA variant sequence is at least about 60% identical, at least about 65% identical, at least about 70% identical, at least about 75% identical, at least about 80% identical, at least about 85% identical, at least about 90% identical, at least about 91% identical, at least about 92% identical, at least about 93% identical, at least about 94% identical, at least about 95% identical, at least about 96% identical, at least about 97% identical, at least about 98% identical or at least about 99% identical to any one of SEQ ID NOS: 2201 to 2280.

In the embodiments of the gNA variants, the gNA further comprises a spacer (or targeting sequence) region, described more fully, supra, which comprises at least 14 to about 35 nucleotides wherein the spacer is designed with a sequence that is complementary to a target DNA. In some embodiments, the gNA variant comprises a targeting sequence of at least 10 to 30 nucleotides complementary to a target DNA. In some embodiments, the targeting sequence has 14, 15, 16, 17, 18, 19, 20, 21, 22, 23, 24, 25, 26, 27, 28, 29, 30, 31, 32, 33, 34 or 35 nucleotides. In some embodiments, the gNA variant comprises a targeting sequence having 20 nucleotides. In some embodiments, the targeting sequence has 25 nucleotides. In some embodiments, the targeting sequence has 24 nucleotides. In some embodiments, the targeting sequence has 23 nucleotides. In some embodiments, the targeting sequence has 22 nucleotides. In some embodiments, the targeting sequence has 21 nucleotides. In some embodiments, the targeting sequence has 20 nucleotides. In some embodiments, the targeting sequence has 19 nucleotides. In some embodiments, the targeting sequence has 18 nucleotides. In some embodiments, the targeting sequence has 17 nucleotides. In some embodiments, the targeting sequence has 16 nucleotides. In some embodiments, the targeting sequence has 15 nucleotides. In some embodiments, the targeting sequence has 14 nucleotides. In some embodiments, the disclosure provides targeting sequences for inclusion in the gNA variants of the disclosure comprising a sequence that is at least 50% identical, at least 55% identical, at least 60% identical, at least 65% identical, at least 70% identical, at least 75% identical, at least 80% identical, at least 85% identical, at least 90% identical, at least 95% identical, or 100% identical to a sequence in Table 3. In some embodiments, the targeting sequence of the gNA variant comprises a sequence a sequence of Table 3 with a single nucleotide removed from the 3' end of the sequence. In other embodiments, the targeting sequence of the gNA variant comprises a sequence a sequence of Table 3 with two nucleotides removed from the 3' end of the sequence. In other embodiments, the targeting sequence of the gNA variant comprises a sequence a sequence of Table 3 with three nucleotides removed from the 3' end of the sequence. In other embodiments, the targeting sequence of the gNA variant comprises a sequence a sequence of Table 3 with four nucleotides removed from the 3' end of the sequence. In other embodiments, the targeting sequence of the gNA variant comprises a sequence a sequence of Table 3 with five nucleotides removed from the 3' end of the sequence.

In some embodiments, the scaffold of the gNA variant is part of an RNP with a reference CasX protein comprising SEQ ID NO: 1, SEQ ID NO: 2, or SEQ ID NO: 3. In other embodiments, the scaffold of the gNA variant is part of an RNP with a CasX variant protein comprising any one of the sequences of Tables 4, 6, 7, 8, or 10, or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto. In the foregoing embodiments, the gNA further comprises a spacer sequence.

In some embodiments, the scaffold of the gNA variant is a variant comprising one or more additional changes to a sequence of a reference gRNA that comprises SEQ ID NO: 4 or SEQ ID NO: 5. In those embodiments where the scaffold of the reference gRNA is derived from SEQ ID NO:

4 or SEQ ID NO: 5, the one or more improved or added characteristics of the gNA variant are improved compared to the same characteristic in SEQ ID NO: 4 or SEQ ID NO: 5.

h. Complex Formation with CasX Protein

In some embodiments, a gNA variant has an improved ability to form a complex with a CasX protein (such as a reference CasX or a CasX variant protein) when compared to a reference gRNA. In some embodiments, a gNA variant has an improved affinity for a CasX protein (such as a reference or variant protein) when compared to a reference gRNA, thereby improving its ability to form a ribonucleoprotein (RNP) complex with the CasX protein, as described in the Examples. Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gNA variant and its spacer are competent for gene editing of a target nucleic acid.

Exemplary nucleotide changes that can improve the ability of gNA variants to form a complex with CasX protein may, in some embodiments, include replacing the scaffold stem with a thermostable stem loop. Without wishing to be bound by any theory, replacing the scaffold stem with a thermostable stem loop could increase the overall binding stability of the gNA variant with the CasX protein. Alternatively, or in addition, removing a large section of the stem loop could change the gNA variant folding kinetics and make a functional folded gNA easier and quicker to structurally-assemble, for example by lessening the degree to which the gNA variant can get "tangled" in itself. In some embodiments, choice of scaffold stem loop sequence could change with different spacers that are utilized for the gNA. In some embodiments, scaffold sequence can be tailored to the spacer and therefore the target sequence. Biochemical assays can be used to evaluate the binding affinity of CasX protein for the gNA variant to form the RNP, including the assays of the Examples. For example, a person of ordinary skill can measure changes in the amount of a fluorescently tagged gNA that is bound to an immobilized CasX protein, as a response to increasing concentrations of an additional unlabeled "cold competitor" gNA. Alternatively, or in addition, fluorescence signal can be monitored to or seeing how it changes as different amounts of fluorescently labeled gNA are flowed over immobilized CasX protein. Alternatively, the ability to form an RNP can be assessed using in vitro cleavage assays against a defined target nucleic acid sequence.

i. gNA Stability

In some embodiments, a gNA variant has improved stability when compared to a reference gRNA. Increased stability and efficient folding may, in some embodiments, increase the extent to which a gNA variant persists inside a target cell, which may thereby increase the chance of forming a functional RNP capable of carrying out CasX functions such as gene editing. Increased stability of gNA variants may also, in some embodiments, allow for a similar outcome with a lower amount of gNA delivered to a cell, which may in turn reduce the chance of off-target effects during gene editing.

In another aspect, the disclosure provides gNA in which the scaffold stem loop and/or the extended stem loop is replaced with a hairpin loop or a thermostable RNA stem loop in which the resulting gNA has increased stability and, depending on the choice of loop, can interact with certain cellular proteins or RNA. In some embodiments, the replacement RNA loop is selected from MS2, Qβ, U1 hairpin II, Uvsx, PP7, Phage replication loop, Kissing loop_a, Kissing loop_b1, Kissing loop_b2, G quadriplex M3q, G quadriplex telomere basket, Sarcin-ricin loop and Pseudoknots. Sequences of gNA variants including such components are provided in Table 2B.

Guide RNA stability can be assessed in a variety of ways, including for example in vitro by assembling the guide, incubating for varying periods of time in a solution that mimics the intracellular environment, and then measuring functional activity via the in vitro cleavage assays described herein. Alternatively, or in addition, gNAs can be harvested from cells at varying time points after initial transfection/transduction of the gNA to determine how long gNA variants persist relative to reference gRNAs.

j. Solubility

In some embodiments, a gNA variant has improved solubility when compared to a reference gRNA. In some embodiments, a gNA variant has improved solubility of the CasX protein:gNA RNP when compared to a reference gRNA. In some embodiments, solubility of the CasX protein:gNA RNP is improved by the addition of a ribozyme sequence to a 5' or 3' end of the gNA variant, for example the 5' or 3' of a reference sgRNA. Some ribozymes, such as the M1 ribozyme, can increase solubility of proteins through RNA mediated protein folding.

Increased solubility of CasX RNPs comprising a gNA variant as described herein can be evaluated through a variety of means known to one of skill in the art, such as by taking densitometry readings on a gel of the soluble fraction of lysed E. coli in which the CasX and gNA variants are expressed.

k. Resistance to Nuclease Activity

In some embodiments, a gNA variant has improved resistance to nuclease activity compared to a reference gRNA. Without wishing to be bound by any theory, increased resistance to nucleases, such as nucleases found in cells, may for example increase the persistence of a variant gNA in an intracellular environment, thereby improving gene editing.

Many nucleases are processive, and degrade RNA in a 3' to 5' fashion. Therefore, in some embodiments the addition of a nuclease resistant secondary structure to one or both termini of the gNA, or nucleotide changes that change the secondary structure of a sgNA, can produce gNA variants with increased resistance to nuclease activity. Resistance to nuclease activity may be evaluated through a variety of methods known to one of skill in the art. For example, in vitro methods of measuring resistance to nuclease activity may include for example contacting reference gNA and variants with one or more exemplary RNA nucleases and measuring degradation. Alternatively, or in addition, measuring persistence of a gNA variant in a cellular environment using the methods described herein can indicate the degree to which the gNA variant is nuclease resistant.

l. Binding Affinity to a Target DNA

In some embodiments, a gNA variant has improved affinity for the target DNA relative to a reference gRNA. In certain embodiments, a ribonucleoprotein complex comprising a gNA variant has improved affinity for the target DNA, relative to the affinity of an RNP comprising a reference gRNA. In some embodiments, the improved affinity of the RNP for the target DNA comprises improved affinity for the target sequence, improved affinity for the PAM sequence, improved ability of the RNP to search DNA for the target sequence, or any combinations thereof. In some embodiments, the improved affinity for the target DNA is the result of increased overall DNA binding affinity.

Without wishing to be bound by theory, it is possible that nucleotide changes in the gNA variant that affect the function of the OBD in the CasX protein may increase the affinity of CasX variant protein binding to the protospacer adjacent motif (PAM), as well as the ability to bind or utilize an increased spectrum of PAM sequences other than the canonical TTC PAM recognized by the reference CasX protein of SEQ ID NO: 2, including PAM sequences selected from the group consisting of TTC, ATC, GTC, and CTC, thereby increasing the affinity and diversity of the CasX variant protein for target DNA sequences resulting in a substantial increase in the target nucleic acid sequences that can be edited and/or bound, compared to a reference CasX.

As described more fully, below, increasing the sequences of the target nucleic acid that can be edited, compared to a reference CasX, refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target cleavage, or it may be some combination of nucleotides from both strands. In the case of the CasX proteins disclosed herein, the PAM is located 5' of the protospacer with at least a single nucleotide separating the PAM from the first nucleotide of the protospacer. Alternatively, or in addition, changes in the gNA that affect function of the helical I and/or helical II domains that increase the affinity of the CasX variant protein for the target DNA strand can increase the affinity of the CasX RNP comprising the variant gNA for target DNA.

m. Adding or Changing gNA Function

In some embodiments, gNA variants can comprise larger structural changes that change the topology of the gNA variant with respect to the reference gRNA, thereby allowing for different gNA functionality. For example, in some embodiments a gNA variant has swapped an endogenous stem loop of the reference gRNA scaffold with a previously identified stable RNA structure or a stem loop that can interact with a protein or RNA binding partner to recruit additional moieties to the CasX or to recruit CasX to a specific location, such as the inside of a viral capsid, that has the binding partner to the said RNA structure. In other scenarios the RNAs may be recruited to each other, as in Kissing loops, such that two CasX proteins can be co-localized for more effective gene editing at the target DNA sequence. Such RNA structures may include MS2, Qβ, U1 hairpin II, Uvsx, PP7, Phage replication loop, Kissing loop_a, Kissing loop_b1, Kissing loop_b2, G quadriplex M3q, G quadriplex telomere basket, Sarcin-ricin loop, or a Pseudoknot.

In some embodiments, a gNA variant comprises a terminal fusion partner. Exemplary terminal fusions may include fusion of the gRNA to a self-cleaving ribozyme or protein binding motif. As used herein, a "ribozyme" refers to an RNA or segment thereof with one or more catalytic activities similar to a protein enzyme. Exemplary ribozyme catalytic activities may include, for example, cleavage and/or ligation of RNA, cleavage and/or ligation of DNA, or peptide bond formation. In some embodiments, such fusions could either improve scaffold folding or recruit DNA repair machinery. For example, a gRNA may in some embodiments be fused to a hepatitis delta virus (HDV) antigenomic ribozyme, HDV genomic ribozyme, hatchet ribozyme (from metagenomic data), env25 pistol ribozyme (representative from Aliistipes putredinis), HH15 Minimal Hammerhead ribozyme, tobacco ringspot virus (TRSV) ribozyme, WT viral Hammerhead ribozyme (and rational variants), or Twisted Sister 1 or RBMX recruiting motif. Hammerhead ribozymes are RNA motifs that catalyze reversible cleavage and ligation reactions at a specific site within an RNA molecule. Hammerhead ribozymes include type I, type II and type III hammerhead ribozymes. The HDV, pistol, and hatchet ribozymes have self-cleaving activities. gNA variants comprising one or more ribozymes may allow for expanded gNA function as compared to a gRNA reference. For example, gNAs comprising self-cleaving ribozymes can, in some embodiments, be transcribed and processed into mature gNAs as part of polycistronic transcripts. Such fusions may occur at either the 5' or the 3' end of the gNA. In some embodiments, a gNA variant comprises a fusion at both the 5' and the 3' end, wherein each fusion is independently as described herein. In some embodiments, a gNA variant comprises a phage replication loop or a tetraloop. In some embodiments, a gNA comprises a hairpin loop that is capable of binding a protein. For example, in some embodiments the hairpin loop is an MS2, Qβ, U1 hairpin II, Uvsx, or PP7 hairpin loop.

In some embodiments, a gNA variant comprises one or more RNA aptamers. As used herein, an "RNA aptamer" refers to an RNA molecule that binds a target with high affinity and high specificity.

In some embodiments, a gNA variant comprises one or more riboswitches. As used herein, a "riboswitch" refers to an RNA molecule that changes state upon binding a small molecule.

In some embodiments, the gNA variant further comprises one or more protein binding motifs. Adding protein binding motifs to a reference gRNA or gNA variant of the disclosure may, in some embodiments, allow a CasX RNP to associate with additional proteins, which can, for example, add the functionality of those proteins to the CasX RNP.

n. Chemically Modified gNA

In some embodiments, the disclosure relates to chemically-modified gNA. In some embodiments, the present disclosure provides a chemically-modified gNA that has guide RNA functionality and has reduced susceptibility to cleavage by a nuclease. A gNA that comprises any nucleotide other than the four canonical ribonucleotides A, C, G, and U, or a deoxynucleotide, is a chemically modified gNA. In some cases, a chemically-modified gNA comprises any backbone or internucleotide linkage other than a natural phosphodiester internucleotide linkage. In certain embodiments, the retained functionality includes the ability of the modified gNA to bind to a CasX of any of the embodiments described herein. In certain embodiments, the retained functionality includes the ability of the modified gNA to bind to a SOD1 target nucleic acid sequence. In certain embodiments, the retained functionality includes targeting a CasX protein or the ability of a pre-complexed CasX protein-gNA to bind to a target nucleic acid sequence. In certain embodiments, the retained functionality includes the ability to nick a target polynucleotide by a CasX-gNA. In certain embodiments, the retained functionality includes the ability to cleave a target nucleic acid sequence by a CasX-gNA. In certain embodiments, the retained functionality is any other known function of a gNA in a CasX system with a CasX protein of the embodiments of the disclosure.

In some embodiments, the disclosure provides a chemically-modified gNA in which a nucleotide sugar modification is incorporated into the gNA selected from the group consisting of 2'-O—C$_{1-4}$alkyl such as 2'-O-methyl (2'-OMe), 2'-deoxy (2'-H), 2'-O—C$_{1-3}$alkyl-O—C$_{1-3}$alkyl such as 2'-methoxyethyl ("2'-MOE"), 2'-fluoro ("2'-F"), 2'-amino ("2'-NH$_2$"), 2'-arabinosyl ("2'-arabino") nucleotide, 2'-F-arabinosyl ("2'-F-arabino") nucleotide, 2'-locked nucleic acid ("LNA") nucleotide, 2'-unlocked nucleic acid ("ULNA") nucleotide, a sugar in L form ("L-sugar"), and 4'-thioribosyl nucleotide. In other embodiments, an internucleotide linkage modification incorporated into the guide RNA is selected from the group consisting of: phosphorothioate "P(S)" (P(S)), phosphonocarboxylate (P(CH$_2$)$_n$COOR) such as phosphonoacetate "PACE" (P(CH$_2$COO$^-$)), thiophosphonocarboxylate ((S)P(CH$_2$)$_n$COOR) such as thiophosphonoacetate "thioPACE" ((S)P(CH$_2$)$_n$COO$^-$)), alkylphosphonate (P(C$_{1-3}$alkyl) such as methylphosphonate—P(CH$_3$), boranophosphonate (P(BH$_3$)), and phosphorodithioate (P(S)$_2$).

In certain embodiments, the disclosure provides a chemically-modified gNA in which a nucleobase ("base") modification is incorporated into the gNA selected from the group consisting of: 2-thiouracil ("2-thioU"), 2-thiocytosine ("2-thioC"), 4-thiouracil ("4-thioU"), 6-thioguanine ("6-thioG"), 2-aminoadenine ("2-aminoA"), 2-aminopurine, pseudouracil, hypoxanthine, 7-deazaguanine, 7-deaza-8-azaguanine, 7-deazaadenine, 7-deaza-8-azaadenine, 5-methylcytosine ("5-methylC"), 5-methyluracil ("5-methylU"), 5-hydroxymethylcytosine, 5-hydroxymethyluracil, 5,6-dehydrouracil, 5-propynylcytosine, 5-propynyluracil, 5-ethynylcytosine, 5-ethynyluracil, 5-allyluracil ("5-allylU"), 5-allylcytosine ("5-allylC"), 5-aminoallyluracil ("5-aminoallylU"), 5-aminoallyl-cytosine ("5-aminoallylC"), an abasic nucleotide, Z base, P base, Unstructured Nucleic Acid ("UNA"), isoguanine ("isoG"), isocytosine ("isoC"), 5-methyl-2-pyrimidine, x(A,G,C,T) and y(A,G,C,T).

In other embodiments, the disclosure provides a chemically-modified gNA in which one or more isotopic modifications are introduced on the nucleotide sugar, the nucleobase, the phosphodiester linkage and/or the nucleotide phosphates, including nucleotides comprising one or more $^{15}$N, $^{13}$C, $^{14}$C, deuterium, $^{3}$H, $^{32}$P, $^{125}$I, $^{131}$I atoms or other atoms or elements used as tracers.

In some embodiments, an "end" modification incorporated into the gNA is selected from the group consisting of: PEG (polyethyleneglycol), hydrocarbon linkers (including: heteroatom (O,S,N)—substituted hydrocarbon spacers; halo-substituted hydrocarbon spacers; keto-, carboxyl-, amido-, thionyl-, carbamoyl-, thionocarbamaoyl-containing hydrocarbon spacers), spermine linkers, dyes including fluorescent dyes (for example fluoresceins, rhodamines, cyanines) attached to linkers such as for example 6-fluorescein-hexyl, quenchers (for example dabcyl, BHQ) and other labels (for example biotin, digoxigenin, acridine, streptavidin, avidin, peptides and/or proteins). In some embodiments, an "end" modification comprises a conjugation (or ligation) of the gNA to another molecule comprising an oligonucleotide of deoxynucleotides and/or ribonucleotides, a peptide, a protein, a sugar, an oligosaccharide, a steroid, a lipid, a folic acid, a vitamin and/or other molecule. In certain embodiments, the disclosure provides a chemically-modified gNA in which an "end" modification (described above) is located internally in the gNA sequence via a linker such as, for example, a 2-(4-butylamidofluorescein)propane-1,3-diol bis(phosphodiester) linker, which is incorporated as a phosphodiester linkage and can be incorporated anywhere between two nucleotides in the gNA.

In some embodiments, the disclosure provides a chemically-modified gNA having an end modification comprising a terminal functional group such as an amine, a thiol (or sulfhydryl), a hydroxyl, a carboxyl, carbonyl, thionyl, thiocarbonyl, a carbamoyl, a thiocarbamoyl, a phoshoryl, an alkene, an alkyne, an halogen or a functional group-terminated linker that can be subsequently conjugated to a desired moiety selected from the group consisting of a fluorescent dye, a non-fluorescent label, a tag (for $^{14}$C, example biotin, avidin, streptavidin, or moiety containing an isotopic label such as $^{15}$N, $^{13}$C, deuterium, $^{3}$H, $^{32}$P, $^{125}$I and the like), an oligonucleotide (comprising deoxynucleotides and/or ribonucleotides, including an aptamer), an amino acid, a peptide, a protein, a sugar, an oligosaccharide, a steroid, a lipid, a folic acid, and a vitamin. The conjugation employs standard chemistry well-known in the art, including but not limited to coupling via N-hydroxysuccinimide, isothiocyanate, DCC (or DCI), and/or any other standard method as described in "Bioconjugate Techniques" by Greg T. Hermanson, Publisher Eslsevier Science, 3$^{rd}$ ed. (2013), the contents of which are incorporated herein by reference in its entirety.

IV. Proteins for Modifying a Target Nucleic Acid

The present disclosure provides systems comprising a CRISPR nuclease that have utility in genome editing of eukaryotic cells. In some embodiments, the CRISPR nuclease is selected from the group consisting of Cas9, Cas12a, Cas12b, Cas12c, Cas12d (CasY), CasX, Cas13a, Cas13b, Cas13c, Cas13d, CasX, CasY, Cas14, Cpf1, C2c1, Csn2, and Cas Phi. In some embodiments, the CRISPR nuclease is a is a Type V CRISPR nuclease. In some embodiments, the present disclosure provides systems comprising a CasX protein and one or more guide nucleic acids (gNA) that are specifically designed to modify a target nucleic acid sequence in eukaryotic cells.

The term "CasX protein", as used herein, refers to a family of proteins, and encompasses all naturally occurring CasX proteins, proteins that share at least 50% identity to naturally occurring CasX proteins, as well as CasX variants possessing one or more improved characteristics relative to a naturally-occurring reference CasX protein. CasX proteins belong to CRISPR-Cas Type V proteins. Exemplary improved characteristics of the CasX variant embodiments include, but are not limited to improved folding of the variant, improved binding affinity to the gNA, improved binding affinity to the target nucleic acid, improved ability to utilize a greater spectrum of PAM sequences in the editing and/or binding of target DNA, improved unwinding of the target DNA, increased editing activity, improved editing efficiency, improved editing specificity, increased percentage of a eukaryotic genome that can be efficiently edited, increased activity of the nuclease, increased target strand loading for double strand cleavage, decreased target strand loading for single strand nicking, decreased off-target cleavage, improved binding of the non-target strand of DNA, improved protein stability, improved protein: gNA (RNP) complex stability, improved protein solubility, improved protein:gNA (RNP) complex solubility, improved protein yield, improved protein expression, and improved fusion characteristics, as described more fully, below. In the foregoing embodiments, the one or more of the improved characteristics of an RNP of the CasX variant and the gNA variant is at least about 1.1 to about 100,000-fold improved relative to an RNP of the reference CasX protein of SEQ ID NO: 1, SEQ ID NO: 2, or SEQ ID NO: 3 and the gNA of Table 2A, when assayed in a comparable fashion. In other cases, the one or more improved characteristics of an RNP of the CasX variant and the gNA variant is at least about 1.1, at least about 10, at least about 100, at least about 1000, at least about 10,000, at least about 100,000-fold or more improved relative to an RNP of the reference CasX protein of SEQ ID NO: 1, SEQ ID NO: 2, or SEQ ID NO: 3 and the gNA of Table 2A. In other cases, the one or more of the improved characteristics of an RNP of the CasX variant and the gNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to an RNP of the reference CasX protein of SEQ ID NO: 1, SEQ ID NO: 2, or SEQ ID NO: 3 and the gNA of Table 2A, when assayed in a comparable fashion. In other cases, the one or more improved characteristics of an RNP of the CasX variant and the gNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to an RNP of the reference CasX protein of SEQ ID NO: 1, SEQ ID NO: 2, or SEQ ID NO: 3 and the gNA of Table 2A, when assayed in a comparable fashion.

The term "CasX variant" is inclusive of variants that are fusion proteins; i.e., the CasX is "fused to" a heterologous sequence. This includes CasX variants comprising CasX variant sequences and N-terminal, C-terminal, or internal fusions of the CasX to a heterologous protein or domain thereof.

CasX proteins of the disclosure comprise at least one of the following domains: a non-target strand binding (NTSB) domain, a target strand loading (TSL) domain, a helical I domain, a helical II domain, an oligonucleotide binding domain (OBD), and a RuvC DNA cleavage domain (the last of which may be modified or deleted in a catalytically dead CasX variant), described more fully, below. Additionally, the CasX variant proteins of the disclosure have an enhanced ability to efficiently edit and/or bind target DNA, when complexed with a gNA as an RNP, utilizing PAM sequences selected from TTC, ATC, GTC, or CTC, compared to an RNP of a reference CasX protein and reference gNA. In some embodiments, the PAM sequence comprises a TC motif. In the foregoing, the PAM sequence is located at least 1 nucleotide 5' to the non-target strand of the protospacer having identity with the targeting sequence of the gNA in a assay system compared to the editing efficiency and/or binding of an RNP comprising a reference CasX protein and reference gNA in a comparable assay system. In one embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is TTC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is ATC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is CTC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is GTC.

In the foregoing embodiments, the increased editing efficiency and/or binding affinity for the one or more PAM sequences is at least about 1.1-fold to at least about 100-fold, or at least about 1.5-fold to at least about 10-fold greater compared to the editing efficiency and/or binding affinity of an RNP of any one of the CasX proteins of SEQ ID NOS: 1-3 and the gNA of Table 2A for the PAM sequences.

In some cases, the CasX protein is a naturally-occurring protein (e.g., naturally occurs in and is isolated from prokaryotic cells). In other embodiments, the CasX protein is not a naturally-occurring protein (e.g., the CasX protein is a CasX variant protein, a chimeric protein, and the like). A naturally-occurring CasX protein (referred to herein as a "reference CasX protein") functions as an endonuclease that catalyzes a double strand break at a specific sequence in a targeted double-stranded DNA (dsDNA). The sequence specificity is provided by the targeting sequence of the associated gNA to which it is complexed, which hybridizes to a target sequence within the target nucleic acid.

In some embodiments, a CasX protein can bind and/or modify (e.g., cleave, nick, methylate, demethylate, etc.) a target nucleic acid and/or a polypeptide associated with target nucleic acid (e.g., methylation or acetylation of a histone tail). In some embodiments, the CasX protein is catalytically dead (dCasX) but retains the ability to bind a target nucleic acid. An exemplary catalytically dead CasX protein comprises one or more mutations in the active site of the RuvC domain of the CasX protein. In some embodiments, a catalytically dead CasX protein comprises substitutions at residues 672, 769 and/or 935 of SEQ ID NO: 1. In one embodiment, a catalytically dead CasX protein comprises substitutions of D672A, E769A and/or D935A in a reference CasX protein of SEQ ID NO: 1. In other embodiments, a catalytically dead CasX protein comprises substitutions at amino acids 659, 756 and/or 922 in a reference CasX protein of SEQ ID NO: 2. In some embodiments, a catalytically dead CasX protein comprises D659A, E756A and/or D922A substitutions in a reference CasX protein of SEQ ID NO: 2. In further embodiments, a catalytically dead CasX protein comprises deletions of all or part of the RuvC domain of the CasX protein. It will be understood that the same foregoing substitutions can similarly be introduced into the CasX variants of the disclosure, resulting in a dCasX variant. In one embodiment, all or a portion of the RuvC domain is deleted from the CasX variant, resulting in a dCasX variant. Catalytically inactive dCasX variant proteins can, in some embodiments, be used for base editing or epigenetic modifications. With a higher affinity for DNA, in some embodiments, catalytically inactive dCasX variant proteins can, relative to catalytically active CasX, find their target nucleic acid faster, remain bound to target nucleic acid for longer periods of time, bind target nucleic acid in a more stable fashion, or a combination thereof, thereby improving these functions of the catalytically dead CasX variant protein compared to a CasX variant that retains its cleavage capability.

a. Non-Target Strand Binding Domain

The reference CasX proteins of the disclosure comprise a non-target strand binding domain (NTSBD). The NTSBD is a domain not previously found in any Cas proteins; for example this domain is not present in Cas proteins such as Cas9, Cas12a/Cpf1, Cas13, Cas14, CASCADE, CSM, or CSY. Without being bound to theory or mechanism, a NTSBD in a CasX allows for binding to the non-target DNA strand and may aid in unwinding of the non-target and target strands. The NTSBD is presumed to be responsible for the unwinding, or the capture, of a non-target DNA strand in the unwound state. The NTSBD is in direct contact with the non-target strand in CryoEM model structures derived to date and may contain a non-canonical zinc finger domain. The NTSBD may also play a role in stabilizing DNA during unwinding, guide RNA invasion and R-loop formation. In some embodiments, an exemplary NTSBD comprises amino acids 101-191 of SEQ ID NO: 1 or amino acids 103-192 of SEQ ID NO: 2. In some embodiments, the NTSBD of a reference CasX protein comprises a four-stranded beta sheet.

b. Target Strand Loading Domain

The reference CasX proteins of the disclosure comprise a Target Strand Loading (TSL) domain. The TSL domain is a domain not found in certain Cas proteins such as Cas9, CASCADE, CSM, or CSY. Without wishing to be bound by theory or mechanism, it is thought that the TSL domain is responsible for aiding the loading of the target DNA strand into the RuvC active site of a CasX protein. In some embodiments, the TSL acts to place or capture the target-strand in a folded state that places the scissile phosphate of the target strand DNA backbone in the RuvC active site. The TSL comprises a cys4 (CXXC, CXXC zinc finger/ribbon domain (SEQ ID NO: 35) that is separated by the bulk of the TSL. In some embodiments, an exemplary TSL comprises amino acids 825-934 of SEQ ID NO: 1 or amino acids 813-921 of SEQ ID NO: 2.

c. Helical I Domain

The reference CasX proteins of the disclosure comprise a helical I domain. Certain Cas proteins other than CasX have domains that may be named in a similar way. However, in some embodiments, the helical I domain of a CasX protein comprises one or more unique structural features, or comprises a unique sequence, or a combination thereof, compared to non-CasX proteins. For example, in some embodiments, the helical I domain of a CasX protein comprises one or more unique secondary structures compared to domains in other Cas proteins that may have a similar name. For example, in some embodiments the helical I domain in a CasX protein comprises one or more alpha helices of unique structure and sequence in arrangement, number and length compared to other CRISPR proteins. In certain embodiments, the helical I domain is responsible for interacting with the bound DNA and spacer of the guide RNA. Without wishing to be bound by theory, it is thought that in some cases the helical I domain may contribute to binding of the protospacer adjacent motif (PAM). In some embodiments, an exemplary helical I domain comprises amino acids 57-100 and 192-332 of SEQ ID NO: 1, or amino acids 59-102 and 193-333 of SEQ ID NO: 2. In some embodiments, the helical I domain of a reference CasX protein comprises one or more alpha helices.

d. Helical II Domain

The reference CasX proteins of the disclosure comprise a helical II domain. Certain Cas proteins other than CasX have domains that may be named in a similar way. However, in some embodiments, the helical II domain of a CasX protein comprises one or more unique structural features, or a unique sequence, or a combination thereof, compared to domains in other Cas proteins that may have a similar name. For example, in some embodiments, the helical II domain comprises one or more unique structural alpha helical bundles that align along the target DNA:guide RNA channel. In some embodiments, in a CasX comprising a helical II domain, the target strand and guide RNA interact with helical II (and the helical I domain, in some embodiments) to allow RuvC domain access to the target DNA. The helical II domain is responsible for binding to the guide RNA scaffold stem loop as well as the bound DNA. In some embodiments, an exemplary helical II domain comprises amino acids 333-509 of SEQ ID NO: 1, or amino acids 334-501 of SEQ ID NO: 2.

e. Oligonucleotide Binding Domain

The reference CasX proteins of the disclosure comprise an Oligonucleotide Binding Domain (OBD). Certain Cas proteins other than CasX have domains that may be named in a similar way. However, in some embodiments, the OBD comprises one or more unique functional features, or comprises a sequence unique to a CasX protein, or a combination thereof. For example, in some embodiments the bridged helix (BH), helical I domain, helical II domain, and Oligonucleotide Binding Domain (OBD) together are responsible for binding of a CasX protein to the guide RNA. Thus, for example, in some embodiments the OBD is unique to a CasX protein in that it interacts functionally with a helical I domain, or a helical II domain, or both, each of which may be unique to a CasX protein as described herein. Specifically, in CasX the OBD largely binds the RNA triplex of the guide RNA scaffold. The OBD may also be responsible for binding to the protospacer adjacent motif (PAM). An exemplary OBD comprises amino acids 1-56 and 510-660 of SEQ ID NO: 1, or amino acids 1-58 and 502-647 of SEQ ID NO: 2.

f. RuvC DNA Cleavage Domain

The reference CasX proteins of the disclosure comprise a RuvC domain, that includes 2 partial RuvC domains (RuvC-I and RuvC-II). The RuvC domain is the ancestral domain of all type 12 CRISPR proteins. The RuvC domain originates from a TNPB (transposase B) like transposase. Similar to other RuvC domains, the CasX RuvC domain has a DED catalytic triad that is responsible for coordinating a magnesium (Mg) ion and cleaving DNA. In some embodiments, the RuvC has a DED motif active site that is responsible for cleaving both strands of DNA (one by one, most likely the non-target strand first at 11-14 nucleotides (nt) into the targeted sequence and then the target strand next at 2-4 nucleotides after the target sequence). Specifically in CasX, the RuvC domain is unique in that it is also responsible for binding the guide RNA scaffold stem loop that is critical for CasX function. An exemplary RuvC domain comprises amino acids 661-824 and 935-986 of SEQ ID NO: 1, or amino acids 648-812 and 922-978 of SEQ ID NO: 2.

g. Reference CasX Proteins

The disclosure provides reference CasX proteins. In some embodiments, a reference CasX protein is a naturally-occurring protein. For example, reference CasX proteins can be isolated from naturally occurring prokaryotes, such as *Deltaproteobacteria, Planctomycetes*, or *Candidatus Sungbacteria* species. A reference CasX protein (sometimes referred to herein as a reference CasX polypeptide) is a type II CRISPR/Cas endonuclease belonging to the CasX (sometimes referred to as Cas12e) family of proteins that is capable of interacting with a guide NA to form a ribonucleoprotein (RNP) complex. In some embodiments, the RNP complex comprising the reference CasX protein can be targeted to a particular site in a target nucleic acid via base pairing between the targeting sequence (or spacer) of the gNA and a target sequence in the target nucleic acid. In some embodiments, the RNP comprising the reference CasX protein is capable of cleaving target DNA. In some embodiments, the RNP comprising the reference CasX protein is capable of nicking target DNA. In some embodiments, the RNP comprising the reference CasX protein is capable of editing target DNA, for example in those embodiments where the reference CasX protein is capable of cleaving or nicking DNA, followed by non-homologous end joining (NHEJ), homology-directed repair (HDR), homology-independent targeted integration (HITI), micro-homology mediated end joining (MMEJ), single strand annealing (SSA) or base excision repair (BER). In some embodiments, the RNP comprises a catalytically dead (is catalytically inactive or has substantially no cleavage activity) CasX protein (dCasX), but retains the ability to bind the target DNA, described more fully, supra.

In some cases, a reference CasX protein is isolated or derived from *Deltaproteobacteria*. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

```
                                                       (SEQ ID NO: 1)
  1   MEKRINKIRK KLSADNATKP VSRSGPMKTL LVRVMTDDLK KRLEKRRKKP EVMPQVISNN

61   AANNLRMLLD DYTKMKEAIL QVYWQEFKDD HVGLMCKFAQ PASKKIDQNK LKPEMDEKGN

121   LTTAGFACSQ CGQPLFVYKL EQVSEKGKAY TNYFGRCNVA EHEKLILLAQ LKPEKDSDEA

181   VTYSLGKFGQ RALDFYSIHV TKESTHPVKP LAQIAGNRYA SGPVGKALSD ACMGTIASFL

241   SKYQDIIIEH QKVVKGNQKR LESLRELAGK ENLEYPSVTL PPQPHTKEGV DAYNEVIARV

301   RMWVNLNLWQ KLKLSRDDAK PLLRLKGFPS FPVVERRENE VDWWNTINEV KKLIDAKRDM

361   GRVFWSGVTA EKRNTILEGY NYLPNENDHK KREGSLENPK KPAKRQFGDL LLYLEKKYAG

421   DWGKVFDEAW ERIDKKIAGL TSHIEREEAR NAEDAQSKAV LTDWLRAKAS FVLERLKEMD

481   EKEFYACEIQ LQKWYGDLRG NPFAVEAENR VVDISGFSIG SDGHSIQYRN LLAWKYLENG

541   KREFYLLMNY GKKGRIRFTD GTDIKKSGKW QGLLYGGGKA KVIDLTFDPD DEQLIILPLA

601   FGTRQGREFI WNDLLSLETG LIKLANGRVI EKTIYNKKIG RDEPALFVAL TFERREVVDP

661   SNIKPVNLIG VDRGENIPAV IALTDPEGCP LPEFKDSSGG PTDILRIGEG YKEKQRAIQA

721   AKEVEQRRAG GYSRKFASKS RNLADDMVRN SARDLFYHAV THDAVLVFEN LSRGFGRQGK

781   RTFMTERQYT KMEDWLTAKL AYEGLTSKTY LSKTLAQYTS KTCSNCGFTI TTADYDGMLV

841   RLKKTSDGWA TTLNNKELKA EGQITYYNRY KRQTVEKELS AELDRLSEES GNNDISKWTK

901   GRRDEALFLL KKRFSHRPVQ EQFVCLDCGH EVHADEQAAL NIARSWLFLN SNSTEFKSYK

961   SGKQPFVGAW QAFYKRRLKE VWKPNA.
```

In some cases, a reference CasX protein is isolated or derived from *Planctomycetes*. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

```
                                                   (SEQ ID NO: 2)
  1    MQEIKRINKI RRRLVKDSNT KKAGKTGPMK TLLVRVMTPD LRERLENLRK KPENIPQPIS

61    NTSRANLNKL LTDYTEMKKA ILHVYWEEFQ KDPVGLMSRV AQPAPKNIDQ RKLIPVKDGN

121    ERLTSSGFAC SQCCQPLYVY KLEQVNDKGK PHTNYFGRCN VSEHERLILL SPHKPEANDE

181    LVTYSLGKFG QRALDFYSIH VTRESNHPVK PLEQIGGNSC ASGPVGKALS DACMGAVASF

241    LTKYQDIILE HQKVIKKNEK RLANLKDIAS ANGLAFPKIT LPPQPHTKEG IEAYNNVVAQ

301    IVIWVNLNLW QKLKIGRDEA KPLQRLKGFP SFPLVERQAN EVDWWDMVCN VKKLINEKKE

361    DGKVFWQNLA GYKRQEALLP YLSSEEDRKK GKKFARYQFG DLLLHLEKKH GEDWGKVYDE

421    AWERIDKKVE GLSKHIKLEE ERRSEDAQSK AALTDWLRAK ASFVIEGLKE ADKDEFCRCE

481    LKLQKWYGDL RGKPFAIEAE NSILDISGFS KQYNCAFIWQ KDGVKKLNLY LIINYFKGGK

541    LRFKKIKPEA FEANRFYTVI NKKSGEIVPM EVNFNFDDPN LIILPLAFGK RQGREFIWND

601    LLSLETGSLK LANGRVIEKT LYNRRTRQDE PALFVALTFE RREVLDSSNI KPMNLIGIDR

661    GENIPAVIAL TDPEGCPLSR FKDSLGNPTH ILRIGESYKE KQRTIQAAKE VEQRRAGGYS

721    RKYASKAKNL ADDMVRNTAR DLLYYAVTQD AMLIFENLSR GFGRQGKRTF MAERQYTRME

781    DWLTAKLAYE GLPSKTYLSK TLAQYTSKTC SNCGFTITSA DYDRVLEKLK KTATGWMTTI

841    NGKELKVEGQ ITYYNRYKRQ NVVKDLSVEL DRLSEESVNN DISSWTKGRS GEALSLLKKR

901    FSHRPVQEKF VCLNCGFETH ADEQAALNIA RSWLFLRSQE YKKYQTNKTT GNTDKRAFVE

961    TWQSFYRKKL KEVWKPAV.
```

In some embodiments, the CasX protein comprises the sequence of SEQ ID NO: 2, or at least 60% similarity thereto. In some embodiments, the CasX protein comprises the sequence of SEQ ID NO: 2, or at least 80% similarity thereto. In some embodiments, the CasX protein comprises the sequence of SEQ ID NO: 2, or at least 90% similarity thereto. In some embodiments, the CasX protein comprises the sequence of SEQ ID NO: 2, or at least 95% similarity thereto. In some embodiments, the CasX protein consists of the sequence of SEQ ID NO: 2. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO: 2. These mutations can be insertions, deletions, amino acid substitutions, or any combinations thereof.

In some cases, a reference CasX protein is isolated or derived from *Candidatus Sungbacteria*. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of

```
                                                                (SEQ ID NO: 3)
  1    MDNANKPSTK SLVNTTRISD HFGVTPGQVT RVFSFGIIPT KRQYAIIERW FAAVEAARER

61    LYGMLYAHFQ ENPPAYLKEK FSYETFFKGR PVLNGLRDID PTIMTSAVFT ALRHKAEGAM

121    AAFHTNHRRL FEEARKKMRE YAECLKANEA LLRGAADIDW DKIVNALRTR LNTCLAPEYD

181    AVIADFGALC AFRALIAETN ALKGAYNHAL NQMLPALVKV DEPEEAEESP RLRFFNGRIN

241    DLPKFPVAER ETPPDTETII RQLEDMARVI PDTAEILGYI HRIRHKAARR KPGSAVPLPQ

301    RVALYCAIRM ERNPEEDPST VAGHFLGEID RVCEKRRQGL VRTPFDSQIR ARYMDIISFR

361    ATLAHPDRWT EIQFLRSNAA SRRVRAETIS APFEGFSWTS NRTNPAPQYG MALAKDANAP

421    ADAPELCICL SPSSAAFSVR EKGGDLIYMR PTGGRRGKDN PGKEITWVPG SFDEYPASGV

481    ALKLRLYFGR SQARRMLTNK TWGLLSDNPR VFAANAELVG KKRNPQDRWK LFFHMVISGP

541    PPVEYLDFSS DVRSRARTVI GINRGEVNPL AYAVVSVEDG QVLEEGLLGK KEYIDQLIET

601    RRRISEYQSR EQTPPRDLRQ RVRHLQDTVL GSARAKIHSL IAFWKGILAI ERLDDQFHGR
```

```
661    EQKIIPKKTY  LANKTGFMNA  LSFSGAVRVD  KKGNPWGGMI  EIYPGGISRT  CTQCGTVWLA

721    RRPKNPGHRD  AMVVIPDIVD  DAAATGFDNV  DCDAGTVDYG  ELFTLSREWV  RLTPRYSRVM

781    RGTLGDLERA  IRQGDDRKSR  QMLELALEPQ  PQWGQFFCHR  CGFNGQSDVL  AATNLARRAI

841    SLIRRLPDTD  TPPTP.
```

In some embodiments, the CasX protein comprises the sequence of SEQ ID NO: 3, or at least 60% similarity thereto. In some embodiments, the CasX protein comprises the sequence of SEQ ID NO: 3, or at least 80% similarity thereto. In some embodiments, the CasX protein comprises the sequence of SEQ ID NO: 3, or at least 90% similarity thereto. In some embodiments, the CasX protein comprises the sequence of SEQ ID NO: 3, or at least 95% similarity thereto. In some embodiments, the CasX protein consists of the sequence of SEQ ID NO: 3. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO: 3. These mutations can be insertions, deletions, amino acid substitutions, or any combinations thereof.

h. CasX Variant Proteins

The present disclosure provides variants of a reference CasX protein (interchangeably referred to herein as "CasX variant" or "CasX variant protein"), wherein the CasX variants comprise at least one modification in at least one domain of the reference CasX protein, including the sequences of SEQ ID NOS: 1-3. In some embodiments, the CasX variant exhibits at least one improved characteristic compared to the reference CasX protein. All variants that improve one or more functions or characteristics of the CasX variant protein when compared to a reference CasX protein described herein are envisaged as being within the scope of the disclosure. In some embodiments, the modification is a mutation in one or more amino acids of the reference CasX. In other embodiments, the modification is a substitution of one or more domains of the reference CasX with one or more domains from a different CasX. In some embodiments, insertion includes the insertion of a part or all of a domain from a different CasX protein. Mutations can occur in any one or more domains of the reference CasX protein, and may include, for example, deletion of part or all of one or more domains, or one or more amino acid substitutions, deletions, or insertions in any domain of the reference CasX protein. The domains of CasX proteins include the non-target strand binding (NTSB) domain, the target strand loading (TSL) domain, the helical I domain, the helical II domain, the oligonucleotide binding domain (OBD), and the RuvC DNA cleavage domain. Any change in amino acid sequence of a reference CasX protein that leads to an improved characteristic of the CasX protein is considered a CasX variant protein of the disclosure. For example, CasX variants can comprise one or more amino acid substitutions, insertions, deletions, or swapped domains, or any combinations thereof, relative to a reference CasX protein sequence.

In some embodiments, the CasX variant protein comprises at least one modification in at least each of two domains of the reference CasX protein, including the sequences of SEQ ID NOS:1-3. In some embodiments, the CasX variant protein comprises at least one modification in at least 2 domains, in at least 3 domains, at least 4 domains or at least 5 domains of the reference CasX protein. In some embodiments, the CasX variant protein comprises two or more modifications in at least one domain of the reference CasX protein. In some embodiments, the CasX variant protein comprises at least two modifications in at least one domain of the reference CasX protein, at least three modifications in at least one domain of the reference CasX protein or at least four modifications in at least one domain of the reference CasX protein. In some embodiments, wherein the CasX variant comprises two or more modifications compared to a reference CasX protein, each modification is made in a domain independently selected from the group consisting of a NTSBD, TSLD, Helical I domain, Helical II domain, OBD, and RuvC DNA cleavage domain.

In some embodiments, the at least one modification of the CasX variant protein comprises a deletion of at least a portion of one domain of the reference CasX protein, including the sequences of SEQ ID NOS:1-3. In some embodiments, the deletion is in the NTSBD, TSLD, Helical I domain, Helical II domain, OBD, or RuvC DNA cleavage domain.

Suitable mutagenesis methods for generating CasX variant proteins of the disclosure may include, for example, Deep Mutational Evolution (DME; described in the Examples), deep mutational scanning (DMS), error prone PCR, cassette mutagenesis, random mutagenesis, staggered extension PCR, gene shuffling, or domain swapping. In some embodiments, the CasX variants are designed, for example by selecting one or more desired mutations in a reference CasX. In certain embodiments, the activity of a reference CasX protein is used as a benchmark against which the activity of one or more CasX variants are compared, thereby measuring improvements in function of the CasX variants. Exemplary improvements of CasX variants include, but are not limited to, improved folding of the variant, improved binding affinity to the gNA, improved binding affinity to the target DNA, altered binding affinity to one or more PAM sequences, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved protein:gNA complex stability, improved protein solubility, improved protein:gNA complex solubility, improved protein yield, improved protein expression, and improved fusion characteristics, as described more fully, below.

In some embodiments of the CasX variants described herein, the at least one modification comprises: (a) a substitution of 1 to 100 consecutive or non-consecutive amino acids in the CasX variant compared to a reference CasX of SEQ ID NO: 1, SEQ ID NO: 2, or SEQ ID NO: 3; (b) a deletion of 1 to 100 consecutive or non-consecutive amino acids in the CasX variant compared to a reference CasX; (c) an insertion of 1 to 100 consecutive or non-consecutive amino acids in the CasX compared to a reference CasX; or (d) any combination of (a)-(c). In some embodiments, the at least one modification comprises: (a) a substitution of 5-10 consecutive or non-consecutive amino acids in the CasX variant compared to a reference CasX of SEQ ID NO: 1, SEQ ID NO: 2, or SEQ ID NO: 3; (b) a deletion of 1-5 consecutive or non-consecutive amino acids in the CasX variant compared to a reference CasX; (c) an insertion of 1-5 consecutive or non-consecutive amino acids in the CasX compared to a reference CasX; or (d) any combination of (a)-(c).

In some embodiments, the CasX variant protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO: 1, SEQ ID NO: 2, or SEQ ID NO: 3. These mutations can be insertions, deletions, amino acid substitutions, or any combinations thereof.

In some embodiments, the CasX variant protein comprises at least one amino acid substitution in at least one domain of a reference CasX protein. In some embodiments, the CasX variant protein comprises at least about 1-4 amino acid substitutions, 1-10 amino acid substitutions, 1-20 amino acid substitutions, 1-30 amino acid substitutions, 1-40 amino acid substitutions, 1-50 amino acid substitutions, 1-60 amino acid substitutions, 1-70 amino acid substitutions, 1-80 amino acid substitutions, 1-90 amino acid substitutions, 1-100 amino acid substitutions, 2-10 amino acid substitutions, 2-20 amino acid substitutions, 2-30 amino acid substitutions, 3-10 amino acid substitutions, 3-20 amino acid substitutions, 3-30 amino acid substitutions, 4-10 amino acid substitutions, 4-20 amino acid substitutions, 3-300 amino acid substitutions, 5-10 amino acid substitutions, 5-20 amino acid substitutions, 5-30 amino acid substitutions, 10-50 amino acid substitutions, or 20-50 amino acid substitutions, relative to a reference CasX protein. In some embodiments, the CasX variant protein comprises at least about 100 amino acid substitutions relative to a reference CasX protein. In some embodiments, the CasX variant protein comprises 1, 2, 3, 4, 5, 6, 7, 8, 9 or 10 amino acid substitutions relative to a reference CasX protein. In some embodiments, the CasX variant protein comprises 1, 2, 3, 4, 5, 6, 7, 8, 9 or 10 amino acid substitutions in a single domain relative to the reference CasX protein. In some embodiments, the amino acid substitutions are conservative substitutions. In other embodiments, the substitutions are non-conservative; e.g., a polar amino acid is substituted for a non-polar amino acid, or vice versa.

In some embodiments, a CasX variant protein comprises 1 amino acid substitution, 2-3 consecutive amino acid substitutions, 2-4 consecutive amino acid substitutions, 2-5 consecutive amino acid substitutions, 2-6 consecutive amino acid substitutions, 2-7 consecutive amino acid substitutions, 2-8 consecutive amino acid substitutions, 2-9 consecutive amino acid substitutions, 2-10 consecutive amino acid substitutions, 2-20 consecutive amino acid substitutions, 2-30 consecutive amino acid substitutions, 2-40 consecutive amino acid substitutions, 2-50 consecutive amino acid substitutions, 2-60 consecutive amino acid substitutions, 2-70 consecutive amino acid substitutions, 2-80 consecutive amino acid substitutions, 2-90 consecutive amino acid substitutions, 2-100 consecutive amino acid substitutions, 3-10 consecutive amino acid substitutions, 3-20 consecutive amino acid substitutions, 3-30 consecutive amino acid substitutions, 4-10 consecutive amino acid substitutions, 4-20 consecutive amino acid substitutions, 3-300 consecutive amino acid substitutions, 5-10 consecutive amino acid substitutions, 5-20 consecutive amino acid substitutions, 5-30 consecutive amino acid substitutions, 10-50 consecutive amino acid substitutions or 20-50 consecutive amino acid substitutions relative to a reference CasX protein. In some embodiments, a CasX variant protein comprises 2, 3, 4, 5, 6, 7, 8, 9, 10, 11, 12, 13, 14, 15, 16, 17, 18, 19 or 20 consecutive amino acid substitutions. In some embodiments, a CasX variant protein comprises a substitution of at least about 100 consecutive amino acids. As used herein "consecutive amino acids" refer to amino acids that are contiguous in the primary sequence of a polypeptide.

In some embodiments, a CasX variant protein comprises two or more substitutions relative to a reference CasX protein, and the two or more substitutions are not in consecutive amino acids of the reference CasX sequence. For example, a first substitution may be in a first domain of the reference CasX protein, and a second substitution may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive substitutions relative to a reference CasX protein. In some embodiments, a CasX variant protein comprises at least 20 non-consecutive substitutions relative to a reference CasX protein. Each non-consecutive substitution may be of any length of amino acids described herein, e.g., 1-4 amino acids, 1-10 amino acids, and the like. In some embodiments, the two or more substitutions relative to the reference CasX protein are not the same length, for example one substitution is one amino acid and a second substitution is three amino acids. In some embodiments, the two or more substitutions relative to the reference CasX protein are the same length, for example both substitutions are two consecutive amino acids in length.

Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference CasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a CasX variant protein of the disclosure.

In some embodiments, a CasX variant protein comprises at least one amino acid deletion relative to a reference CasX protein. In some embodiments, a CasX variant protein comprises a deletion of 1-4 amino acids, 1-10 amino acids, 1-20 amino acids, 1-30 amino acids, 1-40 amino acids, 1-50 amino acids, 1-60 amino acids, 1-70 amino acids, 1-80 amino acids, 1-90 amino acids, 1-100 amino acids, 2-10 amino acids, 2-20 amino acids, 2-30 amino acids, 3-10 amino acids, 3-20 amino acids, 3-30 amino acids, 4-10 amino acids, 4-20 amino acids, 3-300 amino acids, 5-10 amino acids, 5-20 amino acids, 5-30 amino acids, 10-50 amino acids or 20-50 amino acids relative to a reference CasX protein. In some embodiments, a CasX protein comprises a deletion of at least about 100 consecutive amino acids relative to a reference CasX protein. In some embodiments, a CasX variant protein comprises a deletion of at least 1, 2, 3, 4, 5, 6, 7, 8, 9, 10, 20, 30, 40, 50 or 100 consecutive amino acids relative to a reference CasX protein. In some embodiments, a CasX variant protein comprises a deletion of 1, 2, 3, 4, 5, 6, 7, 8, 9 or 10 consecutive amino acids.

In some embodiments, a CasX variant protein comprises two or more deletions relative to a reference CasX protein, and the two or more deletions are not consecutive amino acids. For example, a first deletion may be in a first domain of the reference CasX protein, and a second deletion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive deletions relative to a reference CasX protein. In some embodiments, a CasX variant protein comprises at least 20 non-consecutive deletions relative to a reference CasX protein. Each non-consecutive deletion may be of any length of amino acids described herein, e.g., 1-4 amino acids, 1-10 amino acids, and the like.

In some embodiments, the CasX variant protein comprises at least one amino acid insertion relative to the sequence of SEQ ID NOS:1, 2, or 3. In some embodiments, a CasX variant protein comprises an insertion of 1 amino acid, an insertion of 2-3 consecutive amino acids, 2-4 consecutive amino acids, 2-5 consecutive amino acids, 2-6 consecutive amino acids, 2-7 consecutive amino acids, 2-8 consecutive amino acids, 2-9 consecutive amino acids, 2-10 consecutive amino acids, 2-20 consecutive amino acids, 2-30 consecutive amino acids, 2-40 consecutive amino acids, 2-50 consecutive amino acids, 2-60 consecutive amino acids, 2-70 consecutive amino acids, 2-80 consecutive amino acids, 2-90 consecutive amino acids, 2-100 consecutive amino acids, 3-10 consecutive amino acids, 3-20 consecutive amino acids, 3-30 consecutive amino acids, 4-10 consecutive amino acids, 4-20 consecutive amino acids, 3-300 consecutive amino acids, 5-10 consecutive amino acids, 5-20 consecutive amino acids, 5-30 consecutive amino acids, 10-50 consecutive amino acids or 20-50 consecutive amino acids relative to a reference CasX protein. In some embodiments, the CasX variant protein comprises an insertion of 2, 3, 4, 5, 6, 7, 8, 9, 10, 11, 12, 13, 14, 15, 16, 17, 18, 19 or 20 consecutive amino acids. In some embodiments, a CasX variant protein comprises an insertion of at least about 100 consecutive amino acids.

In some embodiments, a CasX variant protein comprises two or more insertions relative to a reference CasX protein, and the two or more insertions are not consecutive amino acids of the sequence. For example, a first insertion may be in a first domain of the reference CasX protein, and a second insertion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive insertions relative to a reference CasX protein. In some embodiments, a CasX variant protein comprises at least 10 to about 20 or more non-consecutive insertions relative to a reference CasX protein. Each non-consecutive insertion may be of any length of amino acids described herein, e.g., 1-4 amino acids, 1-10 amino acids, and the like.

Any amino acid, or combination of amino acids, can be inserted in the insertions described herein. For example, a proline, arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine or any combination thereof can be inserted into a reference CasX protein of the disclosure to generate a CasX variant protein.

Any permutation of the substitution, insertion and deletion embodiments described herein can be combined to generate a CasX variant protein of the disclosure. For example, a CasX variant protein can comprise at least one substitution and at least one deletion relative to a reference CasX protein sequence, at least one substitution and at least one insertion relative to a reference CasX protein sequence, at least one insertion and at least one deletion relative to a reference CasX protein sequence, or at least one substitution, one insertion and one deletion relative to a reference CasX protein sequence.

In some embodiments, the CasX variant protein has at least about 60% sequence similarity, at least 70% similarity, at least 80% similarity, at least 85% similarity, at least 86% similarity, at least 87% similarity, at least 88% similarity, at least 89% similarity, at least 90% similarity, at least 91% similarity, at least 92% similarity, at least 93% similarity, at least 94% similarity, at least 95% similarity, at least 96% similarity, at least 97% similarity, at least 98% similarity, at least 99% similarity, at least 99.5% similarity, at least 99.6% similarity, at least 99.7% similarity, at least 99.8% similarity or at least 99.9% similarity to one of SEQ ID NO: 1, SEQ ID NO: 2, or SEQ ID NO: 3.

In some embodiments, the CasX variant protein has at least about 60% sequence similarity to SEQ ID NO: 2 or a portion thereof. In some embodiments, the CasX variant protein comprises a substitution of Y789T of SEQ ID NO: 2, a deletion of P793 of SEQ ID NO: 2, a substitution of Y789D of SEQ ID NO: 2, a substitution of T72S of SEQ ID NO: 2, a substitution of I546V of SEQ ID NO: 2, a substitution of E552A of SEQ ID NO: 2, a substitution of A636D of SEQ ID NO: 2, a substitution of F536S of SEQ ID NO:2, a substitution of A708K of SEQ ID NO: 2, a substitution of Y797L of SEQ ID NO: 2, a substitution of L792G SEQ ID NO: 2, a substitution of A739V of SEQ ID NO: 2, a substitution of G791M of SEQ ID NO: 2, an insertion of A at position 661 of SEQ ID NO: 2, a substitution of A788W of SEQ ID NO: 2, a substitution of K390R of SEQ ID NO: 2, a substitution of A751S of SEQ ID NO: 2, a substitution of E385A of SEQ ID NO: 2, an insertion of P at position 696 of SEQ ID NO: 2, an insertion of M at position 773 of SEQ ID NO: 2, a substitution of G695H of SEQ ID NO: 2, an insertion of AS at position 793 of SEQ ID NO: 2, an insertion of AS at position 795 of SEQ ID NO: 2, a substitution of C477R of SEQ ID NO: 2, a substitution of C477K of SEQ ID NO: 2, a substitution of C479A of SEQ ID NO: 2, a substitution of C479L of SEQ ID NO: 2, a substitution of I55F of SEQ ID NO: 2, a substitution of K210R of SEQ ID NO: 2, a substitution of C233S of SEQ ID NO: 2, a substitution of D231N of SEQ ID NO: 2, a substitution of Q338E of SEQ ID NO: 2, a substitution of Q338R of SEQ ID NO: 2, a substitution of L379R of SEQ ID NO: 2, a substitution of K390R of SEQ ID NO: 2, a substitution of L481Q of SEQ ID NO: 2, a substitution of F495S of SEQ ID NO:2, a substitution of D600N of SEQ ID NO: 2, a substitution of T886K of SEQ ID NO: 2, a substitution of A739V of SEQ ID NO: 2, a substitution of K460N of SEQ ID NO: 2, a substitution of I199F of SEQ ID NO: 2, a substitution of G492P of SEQ ID NO: 2, a substitution of T153I of SEQ ID NO: 2, a substitution of R591I of SEQ ID NO: 2, an insertion of AS at position 795 of SEQ ID NO: 2, an insertion of AS at position 796 of SEQ ID NO:2, an insertion of L at position 889 of SEQ ID NO: 2, a substitution of E121D of SEQ ID NO: 2, a substitution of S270W of SEQ ID NO: 2, a substitution of E712Q of SEQ ID NO: 2, a substitution of K942Q of SEQ ID NO: 2, a substitution of E552K of SEQ ID NO:2, a substitution of K25Q of SEQ ID NO: 2, a substitution of N47D of SEQ ID NO: 2, an insertion of T at position 696 of SEQ ID NO: 2, a substitution of L685I of SEQ ID NO: 2, a substitution of N880D of SEQ ID NO: 2, a substitution of Q102R of SEQ ID NO: 2, a substitution of M734K of SEQ ID NO: 2, a substitution of A724S of SEQ ID NO: 2, a substitution of T704K of SEQ ID NO: 2, a substitution of P224K of SEQ ID NO: 2, a substitution of K25R of SEQ ID NO: 2, a substitution of M29E of SEQ ID NO: 2, a substitution of H152D of SEQ ID NO: 2, a substitution of S219R of SEQ ID NO: 2, a substitution of E475K of SEQ ID NO: 2, a substitution of G226R of SEQ ID NO: 2, a substitution of A377K of SEQ ID NO: 2, a substitution of E480K of SEQ ID NO: 2, a substitution of K416E of SEQ ID NO: 2, a substitution of H164R of SEQ ID NO: 2, a substitution of K767R of SEQ ID NO: 2, a substitution of I7F of SEQ ID NO: 2, a substitution of M29R of SEQ ID NO: 2, a substitution of H435R of SEQ ID NO: 2, a substitution of E385Q of SEQ ID NO: 2, a substitution of E385K of SEQ ID NO: 2, a substitution of I279F of SEQ ID NO: 2, a substitution of D489S of SEQ ID NO: 2, a substitution of D732N of SEQ ID NO: 2, a substitution of A739T of SEQ ID NO: 2, a substitution of W885R of SEQ ID NO: 2, a substitution of E53K of SEQ ID NO: 2, a substitution of A238T of SEQ ID NO: 2, a substitution of P283Q of SEQ ID NO: 2, a substitution of E292K of SEQ ID NO: 2, a substitution of Q628E of SEQ ID NO: 2, a substitution of R388Q of SEQ ID NO: 2, a substitution of G791M of SEQ ID NO: 2, a substitution of L792K of SEQ ID NO: 2, a substitution of L792E of SEQ ID NO: 2, a substitution of M779N of SEQ ID NO: 2, a substitution of G27D of SEQ ID NO: 2, a substitution of K955R of SEQ ID NO: 2, a substitution of S867R of SEQ ID NO: 2, a substitution of R693I of SEQ ID NO: 2, a substitution of F189Y of SEQ ID NO: 2, a substitution of V635M of SEQ ID NO: 2, a substitution of F399L of SEQ ID NO: 2, a substitution of E498K of SEQ ID NO: 2, a substitution of E386R of SEQ ID NO: 2, a substitution of V254G of SEQ ID NO: 2, a substitution of P793S of SEQ ID NO: 2, a substitution of K188E of SEQ ID NO: 2, a substitution of QT945KI of SEQ ID NO: 2, a substitution of T620P of SEQ ID NO: 2, a substitution of T946P of SEQ ID NO: 2, a substitution of TT949PP of SEQ ID NO: 2, a substitution of N952T of SEQ ID NO: 2, a substitution of K682E of SEQ ID NO: 2, a substitution of K975R of SEQ ID NO: 2, a substitution of L212P of SEQ ID NO: 2, a substitution of E292R of SEQ ID NO: 2, a substitution of I303K of SEQ ID NO: 2, a substitution of C349E of SEQ ID NO: 2, a substitution of E385P of SEQ ID NO: 2, a substitution of E386N of SEQ ID NO: 2, a substitution of D387K of SEQ ID NO: 2, a substitution of L404K of SEQ ID NO: 2, a substitution of E466H of SEQ ID NO: 2, a substitution of C477Q of SEQ ID NO: 2, a substitution of C477H of SEQ ID NO: 2, a substitution of C479A of SEQ ID NO: 2, a substitution of D659H of SEQ ID NO: 2, a substitution of T806V of SEQ ID NO: 2, a substitution of K808S of SEQ ID NO: 2, an insertion of AS at position 797 of SEQ ID NO: 2, a substitution of V959M of SEQ ID NO: 2, a substitution of K975Q of SEQ ID NO: 2, a substitution of W974G of SEQ ID NO: 2, a substitution of A708Q of SEQ ID NO: 2, a substitution of V711K of SEQ ID NO: 2, a substitution of D733T of SEQ ID NO: 2, a substitution of L742W of SEQ ID NO: 2, a substitution of V747K of SEQ ID NO: 2, a substitution of F755M of SEQ ID NO: 2, a substitution of M771A of SEQ ID NO: 2, a substitution of M771Q of SEQ ID NO: 2, a substitution of W782Q of SEQ ID NO: 2, a substitution of G791F, of SEQ ID NO: 2 a substitution of L792D of SEQ ID NO: 2, a substitution of L792K of SEQ ID NO: 2, a substitution of P793Q of SEQ ID NO: 2, a substitution of P793G of SEQ ID NO: 2, a substitution of Q804A of SEQ ID NO: 2, a substitution of Y966N of SEQ ID NO: 2, a substitution of Y723N of SEQ ID NO: 2, a substitution of Y857R of SEQ ID NO: 2, a substitution of S890R of SEQ ID NO: 2, a substitution of S932M of SEQ ID NO: 2, a substitution of L897M of SEQ ID NO: 2, a substitution of R624G of SEQ ID NO: 2, a substitution of 5603G of SEQ ID NO: 2, a substitution of N737S of SEQ ID NO: 2, a substitution of L307K of SEQ ID NO: 2, a substitution of I658V of SEQ ID NO: 2, an insertion of PT at position 688 of SEQ ID NO: 2, an insertion of SA at position 794 of SEQ ID NO: 2, a substitution of S877R of SEQ ID NO: 2, a substitution of N580T of SEQ ID NO: 2, a substitution of V335G of SEQ ID NO: 2, a substitution of T620S of SEQ ID NO: 2, a substitution of W345G of SEQ ID NO: 2, a substitution of T280S of SEQ ID NO: 2, a substitution of L406P of SEQ ID NO: 2, a substitution of A612D of SEQ ID NO: 2, a substitution of A751S of SEQ ID NO: 2, a substitution of E386R of SEQ ID NO: 2, a substitution of V351M of SEQ ID NO: 2, a substitution of K210N of SEQ ID NO: 2, a substitution of D40A of SEQ ID NO: 2, a substitution of E773G of SEQ ID NO: 2, a substitution of H207L of SEQ ID NO: 2, a substitution of T62A SEQ ID NO: 2, a substitution of T287P of SEQ ID NO: 2, a substitution of T832A of SEQ ID NO: 2, a substitution of A893S of SEQ ID NO: 2, an insertion of V at position 14 of SEQ ID NO: 2, an insertion of AG at position 13 of SEQ ID NO: 2, a substitution of R11V of SEQ ID NO: 2, a substitution of R12N of SEQ ID NO: 2, a substitution of R13H of SEQ ID NO: 2, an insertion of Y at position 13 of SEQ ID NO: 2, a substitution of R12L of SEQ ID NO: 2, an insertion of Q at position 13 of SEQ ID NO: 2, an substitution of V15S of SEQ ID NO: 2, an insertion of D at position 17 of SEQ ID NO: 2 or a combination thereof.

In some embodiments, the CasX variant comprises at least one modification in the NTSB domain.

In some embodiments, the CasX variant comprises at least one modification in the TSL domain. In some embodiments, the at least one modification in the TSL domain comprises an amino acid substitution of one or more of amino acids Y857, 5890, or 5932 of SEQ ID NO: 2.

In some embodiments, the CasX variant comprises at least one modification in the helical I domain. In some embodiments, the at least one modification in the helical I domain comprises an amino acid substitution of one or more of amino acids 5219, L249, E259, Q252, E292, L307, or D318 of SEQ ID NO: 2.

In some embodiments, the CasX variant comprises at least one modification in the helical II domain. In some embodiments, the at least one modification in the helical II domain comprises an amino acid substitution of one or more of amino acids D361, L379, E385, E386, D387, F399, L404, R458, C477, or D489 of SEQ ID NO: 2.

In some embodiments, the CasX variant comprises at least one modification in the OBD domain. In some embodiments, the at least one modification in the OBD comprises an amino acid substitution of one or more of amino acids F536, E552, T620, or 1658 of SEQ ID NO: 2.

In some embodiments, the CasX variant comprises at least one modification in the RuvC DNA cleavage domain. In some embodiments, the at least one modification in the RuvC DNA cleavage domain comprises an amino acid substitution of one or more of amino acids K682, G695, A708, V711, D732, A739, D733, L742, V747, F755, M771, M779, W782, A788, G791, L792, P793, Y797, M799, Q804, 5819, or Y857 or a deletion of amino acid P793 of SEQ ID NO: 2.

In some embodiments, the CasX variant comprises at least one modification compared to the reference CasX sequence of SEQ ID NO: 2 is selected from one or more of:

(a) an amino acid substitution of L379R; (b) an amino acid substitution of A708K; (c) an amino acid substitution of T620P; (d) an amino acid substitution of E385P; (e) an amino acid substitution of Y857R; (0 an amino acid substitution of I658V; (g) an amino acid substitution of F399L; (h) an amino acid substitution of Q252K; (i) an amino acid substitution of L404K; and (j) an amino acid deletion of P793.

In some embodiments, a CasX variant protein comprises at least two amino acid changes to a reference CasX protein amino acid sequence. The at least two amino acid changes can be substitutions, insertions, or deletions of a reference CasX protein amino acid sequence, or any combination thereof. The substitutions, insertions or deletions can be any substitution, insertion or deletion in the sequence of a reference CasX protein described herein. In some embodiments, the changes are contiguous, non-contiguous, or a combination of contiguous and non-contiguous amino acid changes to a reference CasX protein sequence. In some embodiments, the reference CasX protein is SEQ ID NO: 2. In some embodiments, a CasX variant protein comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, at least 40, at least 45, at least 50, at least 55, at least 60, at least 65, at least 70, at least 75, at least 80, at least 85, at least 90, at least 95 or at least 100 amino acid changes to a reference CasX protein sequence. In some embodiments, a CasX variant protein comprises 1-50, 3-40, 5-30, 5-20, 5-15, 5-10, 10-50, 10-40, 10-30, 10-20, 15-50, 15-40, 15-30, 2-25, 2-24, 2-22, 2-23, 2-22, 2-21, 2-20, 2-19, 2-18, 2-17, 2-16, 2-15, 2-14, 2-12, 2-11, 2-10, 2-9, 2-8, 2-7, 2-6, 2-5, 2-4, 2-3, 3-25, 3-24, 3-22, 3-23, 3-22, 3-21, 3-20, 3-19, 3-18, 3-17, 3-16, 3-15, 3-14, 3-12, 3-11, 3-10, 3-9, 3-8, 3-7, 3-6, 3-5, 3-4, 4-25, 4-24, 4-22, 4-23, 4-22, 4-21, 4-20, 4-19, 4-18, 4-17, 4-16, 4-15, 4-14, 4-12, 4-11, 4-10, 4-9, 4-8, 4-7, 4-6, 4-5, 5-25, 5-24, 5-22, 5-23, 5-22, 5-21, 5-20, 5-19, 5-18, 5-17, 5-16, 5-15, 5-14, 5-12, 5-11, 5-10, 5-9, 5-8, 5-7 or 5-6 amino acid changes to a reference CasX protein sequence. In some embodiments, a CasX variant protein comprises 15-20 changes to a reference CasX protein sequence. In some embodiments, a CasX variant protein comprises 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acid changes to a reference CasX protein sequence. In some embodiments, the at least two amino acid changes to the sequence of a reference CasX variant protein are selected from the group consisting of: a substitution of Y789T of SEQ ID NO: 2, a deletion of P793 of SEQ ID NO: 2, a substitution of Y789D of SEQ ID NO: 2, a substitution of T72S of SEQ ID NO: 2, a substitution of I546V of SEQ ID NO: 2, a substitution of E552A of SEQ ID NO: 2, a substitution of A636D of SEQ ID NO: 2, a substitution of F536S of SEQ ID NO:2, a substitution of A708K of SEQ ID NO: 2, a substitution of Y797L of SEQ ID NO: 2, a substitution of L792G SEQ ID NO: 2, a substitution of A739V of SEQ ID NO: 2, a substitution of G791M of SEQ ID NO: 2, an insertion of A at position 661 of SEQ ID NO: 2, a substitution of A788W of SEQ ID NO: 2, a substitution of K390R of SEQ ID NO: 2, a substitution of A751S of SEQ ID NO: 2, a substitution of E385A of SEQ ID NO: 2, an insertion of P at position 696 of SEQ ID NO: 2, an insertion of M at position 773 of SEQ ID NO: 2, a substitution of G695H of SEQ ID NO: 2, an insertion of AS at position 793 of SEQ ID NO: 2, an insertion of AS at position 795 of SEQ ID NO: 2, a substitution of $C_{477}R$ of SEQ ID NO: 2, a substitution of C477K of SEQ ID NO: 2, a substitution of C479A of SEQ ID NO: 2, a substitution of C479L of SEQ ID NO: 2, a substitution of I55F of SEQ ID NO: 2, a substitution of K210R of SEQ ID NO: 2, a substitution of C233S of SEQ ID NO: 2, a substitution of D231N of SEQ ID NO: 2, a substitution of Q338E of SEQ ID NO: 2, a substitution of Q338R of SEQ ID NO: 2, a substitution of L379R of SEQ ID NO: 2, a substitution of K390R of SEQ ID NO: 2, a substitution of L481Q of SEQ ID NO: 2, a substitution of F495S of SEQ ID NO:2, a substitution of D600N of SEQ ID NO: 2, a substitution of T886K of SEQ ID NO: 2, a substitution of A739V of SEQ ID NO: 2, a substitution of K460N of SEQ ID NO: 2, a substitution of I199F of SEQ ID NO: 2, a substitution of G492P of SEQ ID NO: 2, a substitution of T153I of SEQ ID NO: 2, a substitution of R591I of SEQ ID NO: 2, an insertion of AS at position 795 of SEQ ID NO: 2, an insertion of AS at position 796 of SEQ ID NO:2, an insertion of L at position 889 of SEQ ID NO: 2, a substitution of E121D of SEQ ID NO: 2, a substitution of S270W of SEQ ID NO: 2, a substitution of E712Q of SEQ ID NO: 2, a substitution of K942Q of SEQ ID NO: 2, a substitution of E552K of SEQ ID NO:2, a substitution of K25Q of SEQ ID NO: 2, a substitution of N47D of SEQ ID NO: 2, an insertion of T at position 696 of SEQ ID NO: 2, a substitution of L685I of SEQ ID NO: 2, a substitution of N880D of SEQ ID NO: 2, a substitution of Q102R of SEQ ID NO: 2, a substitution of M734K of SEQ ID NO: 2, a substitution of A724S of SEQ ID NO: 2, a substitution of T704K of SEQ ID NO: 2, a substitution of P224K of SEQ ID NO: 2, a substitution of K25R of SEQ ID NO: 2, a substitution of M29E of SEQ ID NO: 2, a substitution of H152D of SEQ ID NO: 2, a substitution of S219R of SEQ ID NO: 2, a substitution of E475K of SEQ ID NO: 2, a substitution of G226R of SEQ ID NO: 2, a substitution of A377K of SEQ ID NO: 2, a substitution of E480K of SEQ ID NO: 2, a substitution of K416E of SEQ ID NO: 2, a substitution of H164R of SEQ ID NO: 2, a substitution of K767R of SEQ ID NO: 2, a substitution of I7F of SEQ ID NO: 2, a substitution of M29R of SEQ ID NO: 2, a substitution of H435R of SEQ ID NO: 2, a substitution of E385Q of SEQ ID NO: 2, a substitution of E385K of SEQ ID NO: 2, a substitution of I279F of SEQ ID NO: 2, a substitution of D489S of SEQ ID NO: 2, a substitution of D732N of SEQ ID NO: 2, a substitution of A739T of SEQ ID NO: 2, a substitution of W885R of SEQ ID NO: 2, a substitution of E53K of SEQ ID NO: 2, a substitution of A238T of SEQ ID NO: 2, a substitution of P283Q of SEQ ID NO: 2, a substitution of E292K of SEQ ID NO: 2, a substitution of Q628E of SEQ ID NO: 2, a substitution of R388Q of SEQ ID NO: 2, a substitution of G791M of SEQ ID NO: 2, a substitution of L792K of SEQ ID NO: 2, a substitution of L792E of SEQ ID NO: 2, a substitution of M779N of SEQ ID NO: 2, a substitution of G27D of SEQ ID NO: 2, a substitution of K955R of SEQ ID NO: 2, a substitution of S867R of SEQ ID NO: 2, a substitution of R693I of SEQ ID NO: 2, a substitution of F189Y of SEQ ID NO: 2, a substitution of V635M of SEQ ID NO: 2, a substitution of F399L of SEQ ID NO: 2, a substitution of E498K of SEQ ID NO: 2, a substitution of E386R of SEQ ID NO: 2, a substitution of V254G of SEQ ID NO: 2, a substitution of P793S of SEQ ID NO: 2, a substitution of K188E of SEQ ID NO: 2, a substitution of QT945KI of SEQ ID NO: 2, a substitution of T620P of SEQ ID NO: 2, a substitution of T946P of SEQ ID NO: 2, a substitution of TT949PP of SEQ ID NO: 2, a substitution of N952T of SEQ ID NO: 2, a substitution of K682E of SEQ ID NO: 2, a substitution of K975R of SEQ ID NO: 2, a substitution of L212P of SEQ ID NO: 2, a substitution of E292R of SEQ ID NO: 2, a substitution of I303K of SEQ ID NO: 2, a substitution of C349E of SEQ ID NO: 2, a substitution of E385P of SEQ ID NO: 2, a substitution of E386N of SEQ ID NO: 2, a substitution of D387K of SEQ ID NO: 2, a substitution of L404K of SEQ ID NO: 2, a substitution of E466H of SEQ ID NO: 2, a substitution of C477Q of SEQ ID NO: 2, a substitution of C477H of SEQ ID NO: 2, a substitution of C479A of SEQ ID NO: 2, a substitution of D659H of SEQ ID NO: 2, a substitution of T806V of SEQ ID NO: 2, a substitution of K808S of SEQ ID NO: 2, an insertion of AS at position 797 of SEQ ID NO: 2, a substitution of V959M of SEQ ID NO: 2, a substitution of K975Q of SEQ ID NO: 2, a substitution of W974G of SEQ ID NO: 2, a substitution of A708Q of SEQ ID NO: 2, a substitution of V711K of SEQ ID NO: 2, a substitution of D733T of SEQ ID NO: 2, a substitution of L742W of SEQ ID NO: 2, a substitution of V747K of SEQ ID NO: 2, a substitution of F755M of SEQ ID NO: 2, a substitution of M771A of SEQ ID NO: 2, a substitution of M771Q of SEQ ID NO: 2, a substitution of W782Q of SEQ ID NO: 2, a substitution of G791F, of SEQ ID NO: 2 a substitution of L792D of SEQ ID NO: 2, a substitution of L792K of SEQ ID NO: 2, a substitution of P793Q of SEQ ID NO: 2, a substitution of P793G of SEQ ID NO: 2, a substitution of Q804A of SEQ ID NO: 2, a substitution of Y966N of SEQ ID NO: 2, a substitution of Y723N of SEQ ID NO: 2, a substitution of Y857R of SEQ ID NO: 2, a substitution of S890R of SEQ ID NO: 2, a substitution of S932M of SEQ ID NO: 2, a substitution of L897M of SEQ ID NO: 2, a substitution of R624G of SEQ ID NO: 2, a substitution of S603G of SEQ ID NO: 2, a substitution of N737S of SEQ ID NO: 2, a substitution of L307K of SEQ ID NO: 2, a substitution of I658V of SEQ ID NO: 2, an insertion of PT at position 688 of SEQ ID NO: 2, an insertion of SA at position 794 of SEQ ID NO: 2, a substitution of S877R of SEQ ID NO: 2, a substitution of N580T of SEQ ID NO: 2, a substitution of V335G of SEQ ID NO: 2, a substitution of T620S of SEQ ID NO: 2, a substitution of W345G of SEQ ID NO: 2, a substitution of T280S of SEQ ID NO: 2, a substitution of L406P of SEQ ID NO: 2, a substitution of A612D of SEQ ID NO: 2, a substitution of A751S of SEQ ID NO: 2, a substitution of E386R of SEQ ID NO: 2, a substitution of V351M of SEQ ID NO: 2, a substitution of K210N of SEQ ID NO: 2, a substitution of D40A of SEQ ID NO: 2, a substitution of E773G of SEQ ID NO: 2, a substitution of H207L of SEQ ID NO: 2, a substitution of T62A SEQ ID NO: 2, a substitution of T287P of SEQ ID NO: 2, a substitution of T832A of SEQ ID NO: 2, a substitution of A893S of SEQ ID NO: 2, an insertion of V at position 14 of SEQ ID NO: 2, an insertion of AG at position 13 of SEQ ID NO: 2, a substitution of R11V of SEQ ID NO: 2, a substitution of R12N of SEQ ID NO: 2, a substitution of R13H of SEQ ID NO: 2, an insertion of Y at position 13 of SEQ ID NO: 2, a substitution of R12L of SEQ ID NO: 2, an insertion of Q at position 13 of SEQ ID NO: 2, an substitution of V15S of SEQ ID NO: 2 and an insertion of D at position 17 of SEQ ID NO: 2. In some embodiments, the at least two amino acid changes to a reference CasX protein are selected from the amino acid changes disclosed in the sequences of Table 4. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, the reference CasX protein comprises or consists essentially of SEQ ID NO: 2. In some embodiments, a CasX variant protein comprises a substitution of S794R and a substitution of Y797L of SEQ ID NO: 2. In some embodiments, a CasX variant protein comprises a substitution of K416E and a substitution of A708K of SEQ ID NO: 2. In some embodiments, a CasX variant protein comprises a substitution of A708K and a deletion of P793 of SEQ ID NO: 2. In some embodiments, a CasX variant protein comprises a deletion of P793 and an insertion of AS at position 795 SEQ ID NO: 2. In some embodiments, a CasX variant protein comprises a substitution of Q367K and a substitution of I425S of SEQ ID NO: 2. In some embodiments, a CasX variant protein comprises a substitution of A708K, a deletion of P position 793 and a substitution A793V of SEQ ID NO: 2. In some embodiments, a CasX variant protein comprises a substitution of Q338R and a substitution of A339E of SEQ ID NO: 2. In some embodiments, a CasX variant protein comprises a substitution of Q338R and a substitution of A339K of SEQ ID NO: 2. In some embodiments, a CasX variant protein comprises a substitution of S507G and a substitution of G508R of SEQ ID NO: 2. In some embodiments, a CasX variant protein comprises a substitution of L379R, a substitution of A708K and a deletion of P at position 793 of SEQ ID NO: 2. In some embodiments, a CasX variant protein comprises a substitution of C477K, a substitution of A708K and a deletion of P at position 793 of SEQ ID NO: 2. In some embodiments, a CasX variant protein comprises a substitution of L379R, a substitution of C477K, a substitution of A708K and a deletion of P at position of 793 of SEQ ID NO: 2. In some embodiments, a CasX variant protein comprises a substitution of L379R, a substitution of A708K, a deletion of P at position 793 and a substitution A739V of SEQ ID NO: 2. In some embodiments, a CasX variant protein comprises a substitution of C477K, a substitution of A708K, a deletion of P at position 793 and a substitution of A739V of SEQ ID NO: 2. In some embodiments, a CasX variant protein comprises a substitution of L379R, a substitution of C477K, a substitution of A708K, a deletion of P at position 793 and a substitution of A739V of SEQ ID NO: 2. In some embodiments, a CasX variant protein comprises a substitution of L379R, a substitution of A708K, a deletion of P at position 793 and a substitution of M779N of SEQ ID NO: 2. In some embodiments, a CasX variant protein comprises a substitution of L379R, a substitution of A708K, a deletion of P at position 793 and a substitution of M771N of SEQ ID NO: 2. In some embodiments, a CasX variant protein comprises a substitution of L379R, a substitution of 708K, a deletion of P at position 793 and a substitution of D489S of SEQ ID NO: 2. In some embodiments, a CasX variant protein comprises a substitution of L379R, a substitution of A708K, a deletion of P at position 793 and a substitution of A739T of SEQ ID NO: 2. In some embodiments, a CasX variant protein comprises a substitution of L379R, a substitution of A708K, a deletion of P at position 793 and a substitution of D732N of SEQ ID NO: 2. In some embodiments, a CasX variant protein comprises a substitution of L379R, a substitution of A708K, a deletion of P at position 793 and a substitution of G791M of SEQ ID NO: 2. In some embodiments, a CasX variant protein comprises a substitution of L379R, a substitution of 708K, a deletion of P at position 793 and a substitution of Y797L of SEQ ID NO: 2. In some embodiments, a CasX variant protein comprises a substitution of L379R, a substitution of C477K, a substitution of A708K, a deletion of P at position 793 and a substitution of M779N of SEQ ID NO: 2. In some embodiments, a CasX variant protein comprises a substitution of L379R, a substitution of C477K, a substitution of A708K, a deletion of P at position 793 and a substitution of M771N of SEQ ID NO: 2. In some embodiments, a CasX variant protein comprises a substitution of L379R, a substitution of C477K, a substitution of A708K, a deletion of P at position 793 and a substitution of D489S of SEQ ID NO: 2. In some embodiments, a CasX variant protein comprises a substitution of L379R, a substitution of C477K, a substitution of A708K, a deletion of P at position 793 and a substitution of A739T of SEQ ID NO: 2. In some embodiments, a CasX variant protein comprises a substitution of L379R, a substitution of C477K, a substitution of A708K, a deletion of P at position 793 and a substitution of D732N of SEQ ID NO: 2. In some embodiments, a CasX variant protein comprises a substitution of L379R, a substitution of C477K, a substitution of A708K, a deletion of P at position 793 and a substitution of G791M of SEQ ID NO: 2. In some embodiments, a CasX variant protein comprises a substitution of L379R, a substitution of C477K, a substitution of A708K, a deletion of P at position 793 and a substitution of Y797L of SEQ ID NO: 2. In some embodiments, a CasX variant protein comprises a substitution of L379R, a substitution of C477K, a substitution of A708K, a deletion of P at position 793 and a substitution of T620P of SEQ ID NO: 2. In some embodiments, a CasX variant protein comprises a substitution of A708K, a deletion of P at position 793 and a substitution of E386S of SEQ ID NO: 2. In some embodiments, a CasX variant protein comprises a substitution of E386R, a substitution of F399L and a deletion of P at position 793 of SEQ ID NO: 2. In some embodiments, a CasX variant protein comprises a substitution of R581I and A739V of SEQ ID NO: 2. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, a CasX variant protein comprises a substitution of A708K, a deletion of P at position 793 and a substitution of A739V of SEQ ID NO: 2. In some embodiments, a CasX variant protein comprises a substitution of L379R, a substitution of A708K and a deletion of P at position 793 of SEQ ID NO: 2. In some embodiments, a CasX variant protein comprises a substitution of C477K, a substitution of A708K and a deletion of P at position 793 of SEQ ID NO: 2. In some embodiments, a CasX variant protein comprises a substitution of L379R, a substitution of C477K, a substitution of A708K and a deletion of P at position 793 of SEQ ID NO: 2. In some embodiments, a CasX variant protein comprises a substitution of L379R, a substitution of A708K, a deletion of P at position 793 and a substitution of A739V of SEQ ID NO: 2. In some embodiments, a CasX variant protein comprises a substitution of C477K, a substitution of A708K, a deletion of P at position 793 and a substitution of A739 of SEQ ID NO: 2. In some embodiments, a CasX variant protein comprises a substitution of L379R, a substitution of C477K, a substitution of A708K, a deletion of P at position 793 and a substitution of A739V of SEQ ID NO: 2. In some embodiments, a CasX variant protein comprises a substitution of L379R, a substitution of C477K, a substitution of A708K, a deletion of P at position 793 and a substitution of T620P of SEQ ID NO: 2. In some embodiments, a CasX variant protein comprises a substitution of M771A of SEQ ID NO: 2. In some embodiments, a CasX variant protein comprises a substitution of L379R, a substitution of A708K, a deletion of P at position 793 and a substitution of D732N of SEQ ID NO: 2. In some embodiments, a CasX variant comprises any combination of the foregoing embodiments of this paragraph.

In some embodiments, a CasX variant protein comprises a substitution of W782Q of SEQ ID NO: 2. In some embodiments, a CasX variant protein comprises a substitution of M771Q of SEQ ID NO: 2. In some embodiments, a CasX variant protein comprises a substitution of R458I and a substitution of A739V of SEQ ID NO: 2. In some embodiments, a CasX variant protein comprises a substitution of L379R, a substitution of A708K, a deletion of P at position 793 and a substitution of M771N of SEQ ID NO: 2. In some embodiments, a CasX variant protein comprises a substitution of L379R, a substitution of A708K, a deletion of P at position 793 and a substitution of A739T of SEQ ID NO: 2. In some embodiments, a CasX variant protein comprises a substitution of L379R, a substitution of C477K, a substitution of A708K, a deletion of P at position 793 and a substitution of D489S of SEQ ID NO: 2. In some embodiments, a CasX variant protein comprises a substitution of L379R, a substitution of C477K, a substitution of A708K, a deletion of P at position 793 and a substitution of D732N of SEQ ID NO: 2. In some embodiments, a CasX variant protein comprises a substitution of V711K of SEQ ID NO: 2. In some embodiments, a CasX variant protein comprises a substitution of L379R, a substitution of C477K, a substitution of A708K, a deletion of P at position 793 and a substitution of Y797L of SEQ ID NO: 2. In some embodiments, a CasX variant protein comprises a substitution of L379R, a substitution of A708K and a deletion of P at position 793 of SEQ ID NO: 2. In some embodiments, a CasX variant protein comprises a substitution of L379R, a substitution of C477K, a substitution of A708K, a deletion of P at position 793 and a substitution of M771N of SEQ ID NO: 2. In some embodiments, a CasX variant protein comprises a substitution of A708K, a substitution of P at position 793 and a substitution of E386S of SEQ ID NO: 2. In some embodiments, a CasX variant protein comprises a substitution of L379R, a substitution of C477K, a substitution of A708K and a deletion of P at position 793 of SEQ ID NO: 2. In some embodiments, a CasX variant protein comprises a substitution of L792D of SEQ ID NO: 2. In some embodiments, a CasX variant protein comprises a substitution of G791F of SEQ ID NO: 2. In some embodiments, a CasX variant protein comprises a substitution of A708K, a deletion of P at position 793 and a substitution of A739V of SEQ ID NO: 2. In some embodiments, a CasX variant protein comprises a substitution of L379R, a substitution of A708K, a deletion of P at position 793 and a substitution of A739V of SEQ ID NO: 2. In some embodiments, a CasX variant protein comprises a substitution of C477K, a substitution of A708K and a substitution of P at position 793 of SEQ ID NO: 2. In some embodiments, a CasX variant protein comprises a substitution of L249I and a substitution of M771N of SEQ ID NO: 2. In some embodiments, a CasX variant protein comprises a substitution of V747K of SEQ ID NO: 2. In some embodiments, a CasX variant protein comprises a substitution of L379R, a substitution of C477, a substitution of A708K, a deletion of P at position 793 and a substitution of M779N of SEQ ID NO: 2. In some embodiments, a CasX variant protein comprises a substitution of F755M. In some embodiments, a CasX variant comprises any combination of the foregoing embodiments of this paragraph.

In some embodiments, a CasX variant protein comprises at least one modification compared to the reference CasX sequence of SEQ ID NO: 2, wherein the at least one modification is selected from one or more of: an amino acid substitution of L379R; an amino acid substitution of A708K; an amino acid substitution of T620P; an amino acid substitution of E385P; an amino acid substitution of Y857R; an amino acid substitution of I658V; an amino acid substitution of F399L; an amino acid substitution of Q252K; and an amino acid deletion of [P793]. In some embodiments, a CasX variant protein comprises at least one modification compared to the reference CasX sequence of SEQ ID NO: 2, wherein the at least one modification is selected from one or more of: an amino acid substitution of L379R; an amino acid substitution of A708K; an amino acid substitution of T620P; an amino acid substitution of E385P; an amino acid substitution of Y857R; an amino acid substitution of I658V; an amino acid substitution of F399L; an amino acid substitution of Q252K; an amino acid substitution of L404K; and an amino acid deletion of [P793]. In other embodiments, a CasX variant protein comprises any combination of the foregoing substitutions or deletions compared to the reference CasX sequence of SEQ ID NO: 2. In other embodiments, the CasX variant protein can, in addition to the foregoing substitutions or deletions, further comprise a substitution of an NTSB and/or a helical 1b domain from the reference CasX of SEQ ID NO: 1.

In some embodiments, the CasX variant protein comprises between 400 and 2000 amino acids, between 500 and 1500 amino acids, between 700 and 1200 amino acids, between 800 and 1100 amino acids, or between 900 and 1000 amino acids.

In some embodiments, the CasX variant protein comprises one or more modifications in a region of non-contiguous residues that form a channel in which gNA:target DNA complexing occurs. In some embodiments, the CasX variant protein comprises one or more modifications comprising a region of non-contiguous residues that form an interface which binds with the gNA. For example, in some embodiments of a reference CasX protein, the helical I, helical II and OBD domains all contact or are in proximity to the gNA:target DNA complex, and one or more modifications to non-contiguous residues within any of these domains may improve function of the CasX variant protein.

In some embodiments, the CasX variant protein comprises one or more modifications in a region of non-contiguous residues that form a channel which binds with the non-target strand DNA. For example, a CasX variant protein can comprise one or more modifications to non-contiguous residues of the NTSBD. In some embodiments, the CasX variant protein comprises one or more modifications in a region of non-contiguous residues that form an interface which binds with the PAM. For example, a CasX variant protein can comprise one or more modifications to non-contiguous residues of the helical I domain or OBD. In some embodiments, the CasX variant protein comprises one or more modifications comprising a region of non-contiguous surface-exposed residues. As used herein, "surface-exposed residues" refers to amino acids on the surface of the CasX protein, or amino acids in which at least a portion of the amino acid, such as the backbone or a part of the side chain is on the surface of the protein. Surface exposed residues of cellular proteins such as CasX, which are exposed to an aqueous intracellular environment, are frequently selected from positively charged hydrophilic amino acids, for example arginine, asparagine, aspartate, glutamine, glutamate, histidine, lysine, serine, and threonine. Thus, for example, in some embodiments of the variants provided herein, a region of surface exposed residues comprises one or more insertions, deletions, or substitutions compared to a reference CasX protein. In some embodiments, one or more positively charged residues are substituted for one or more other positively charged residues, or negatively charged residues, or uncharged residues, or any combinations thereof. In some embodiments, one or more amino acids residues for substitution are near bound nucleic acid, for example residues in the RuvC domain or helical I domain that contact target DNA, or residues in the OBD or helical II domain that bind the gNA, can be substituted for one or more positively charged or polar amino acids.

In some embodiments, the CasX variant protein comprises one or more modifications in a region of non-contiguous residues that form a core through hydrophobic packing in a domain of the reference CasX protein. Without wishing to be bound by any theory, regions that form cores through hydrophobic packing are rich in hydrophobic amino acids such as valine, isoleucine, leucine, methionine, phenylalanine, tryptophan, and cysteine. For example, in some reference CasX proteins, RuvC domains comprise a hydrophobic pocket adjacent to the active site. In some embodiments, between 2 to 15 residues of the region are charged, polar, or base-stacking. Charged amino acids (sometimes referred to herein as residues) may include, for example, arginine, lysine, aspartic acid, and glutamic acid, and the side chains of these amino acids may form salt bridges provided a bridge partner is also present. Polar amino acids may include, for example, glutamine, asparagine, histidine, serine, threonine, tyrosine, and cysteine. Polar amino acids can, in some embodiments, form hydrogen bonds as proton donors or acceptors, depending on the identity of their side chains. As used herein, "base-stacking" includes the interaction of aromatic side chains of an amino acid residue (such as tryptophan, tyrosine, phenylalanine, or histidine) with stacked nucleotide bases in a nucleic acid. Any modification to a region of non-contiguous amino acids that are in close spatial proximity to form a functional part of the CasX variant protein is envisaged as within the scope of the disclosure.

i. CasX Variant Proteins with Domains from Multiple Source Proteins

In certain embodiments, the disclosure provides a chimeric CasX protein comprising protein domains from two or more different CasX proteins, such as two or more reference CasX proteins, or two or more CasX variant protein sequences as described herein. As used herein, a "chimeric CasX protein" refers to a CasX containing at least two domains isolated or derived from different sources, such as two naturally occurring proteins, which may, in some embodiments, be isolated from different species. For example, in some embodiments, a chimeric CasX protein comprises a first domain from a first CasX protein and a second domain from a second, different CasX protein. In some embodiments, the first domain can be selected from the group consisting of the NTSB, TSL, Helical I, Helical II, OBD and RuvC domains. In some embodiments, the second domain is selected from the group consisting of the NTSB, TSL, Helical I, Helical II, OBD and RuvC domains with the second domain being different from the foregoing first domain. For example, a chimeric CasX protein may comprise an NTSB, TSL, Helical I, Helical II, OBD domains from a CasX protein of SEQ ID NO: 2, and a RuvC domain from a CasX protein of SEQ ID NO: 1, or vice versa. As a further example, a chimeric CasX protein may comprise an NTSB, TSL, Helical II, OBD and RuvC domain from CasX protein of SEQ ID NO: 2, and a Helical I domain from a CasX protein of SEQ ID NO: 1, or vice versa. Thus, in certain embodiments, a chimeric CasX protein may comprise an NTSB, TSL, Helical II, OBD and RuvC domain from a first CasX protein, and a Helical I domain from a second CasX protein. In some embodiments of the chimeric CasX proteins, the domains of the first CasX protein are derived from the sequences of SEQ ID NO: 1, SEQ ID NO: 2 or SEQ ID NO: 3, and the domains of the second CasX protein are derived from the sequences of SEQ ID NO: 1, SEQ ID NO: 2 or SEQ ID NO: 3, and the first and second CasX proteins are not the same. In some embodiments, domains of the first CasX protein comprise sequences derived from SEQ ID NO: 1 and domains of the second CasX protein comprise sequences derived from SEQ ID NO: 2. In some embodiments, domains of the first CasX protein comprise sequences derived from SEQ ID NO: 1 and domains of the second CasX protein comprise sequences derived from SEQ ID NO: 3. In some embodiments, domains of the first CasX protein comprise sequences derived from SEQ ID NO: 2 and domains of the second CasX protein comprise sequences derived from SEQ ID NO: 3. In some embodiments, the CasX variant is selected of group consisting of CasX variants 387, 388, 389, 390, 395, 485, 486, 487, 488, 489, 490, and 491, the sequences of which are set forth in Table 4.

In some embodiments, a CasX variant protein comprises at least one chimeric domain comprising a first part from a first CasX protein and a second part from a second, different CasX protein. As used herein, a "chimeric domain" refers to a domain containing at least two parts isolated or derived from different sources, such as two naturally occurring proteins or portions of domains from two reference CasX proteins. The at least one chimeric domain can be any of the NTSB, TSL, helical I, helical II, OBD or RuvC domains as described herein. In some embodiments, the first portion of a CasX domain comprises a sequence of SEQ ID NO: 1 and the second portion of a CasX domain comprises a sequence of SEQ ID NO: 2. In some embodiments, the first portion of the CasX domain comprises a sequence of SEQ ID NO: 1 and the second portion of the CasX domain comprises a sequence of SEQ ID NO: 3. In some embodiments, the first portion of the CasX domain comprises a sequence of SEQ ID NO: 2 and the second portion of the CasX domain comprises a sequence of SEQ ID NO: 3. In some embodiments, the at least one chimeric domain comprises a chimeric RuvC domain. As an example of the foregoing, the chimeric RuvC domain comprises amino acids 661 to 824 of SEQ ID NO: 1 and amino acids 922 to 978 of SEQ ID NO: 2. As an alternative example of the foregoing, a chimeric RuvC domain comprises amino acids 648 to 812 of SEQ ID NO: 2 and amino acids 935 to 986 of SEQ ID NO: 1. In some embodiments, a CasX protein comprises a first domain from a first CasX protein and a second domain from a second CasX protein, and at least one chimeric domain comprising at least two parts isolated from different CasX proteins using the approach of the embodiments described in this paragraph. In the foregoing embodiments, the chimeric CasX proteins having domains or portions of domains derived from SEQ ID NOS: 1, 2 and 3, can further comprise amino acid insertions, deletions, or substitutions of any of the embodiments disclosed herein.

In some embodiments, a CasX variant protein comprises a sequence set forth in Tables 4, 6, 7, 8, or 10. In some embodiments, a CasX variant protein consists of a sequence set forth in Table 4. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence set forth in Tables 4, 6, 7, 8, or 10. In other embodiments, a CasX variant protein comprises a sequence set forth in Table 4, and further comprises one or more NLS disclosed herein at or near either the N-terminus, the C-terminus, or both. It will be understood that in some cases, the N-terminal methionine of the CasX variants of the Tables is removed from the expressed CasX variant during post-translational modification.

TABLE 4

CasX Variant Sequences

| Description* | Amino Acid Sequence |
|---|---|
| TSL, Helical I, Helical II, OBD and RuvC domains from SEQ ID NO: 2 and an NTSB domain from SEQ ID NO: 1 | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPASKKI DQNKLKPEMDEKGNLTTAGFACSQCGQPLFVYKLEQVSEKGKAYTNYFGRCNVA EHEKLILLAQLKPEKDSDEAVTYSLGKFGQRALDFYSIHVTRESNHPVKPLEQI GGNSCASGPVGKALSDACMGAVASFLTKYQDIILEHQKVIKKNEKRLANLKDIA SANGLAFPKITLPPQPHTKEGIEAYNNVVAQIVIWVNLNLWQKLKIGRDEAKPL QRLKGFPSFPLVERQANEVDWWDMVCNVKKLINEKKEDGKVFWQNLAGYKRQEA LRPYLSSEEDRKKGKKFARYQFGDLLLHLEKKHGEDWGKVYDEAWERIDKKVEG LSKHIKLEEERRSEDAQSKAALTDWLRAKASFVIEGLKEADKDEFCRCELKLQK WYGDLRGKPFAIEAENSILDISGFSKQYNCAFIWQKDGVKKLNLYLIINYFKGG KLRFKKIKPEAFEANRFYTVINKKSGEIVPMEVNFNFDDPNLIILPLAFGKRQG REFIWNDLLSLETGSLKLANGRVIEKTLYNRRTRQDEPALFVALTFERREVLDS SNIKPMNLIGIDRGENIPAVIALTDPEGCPLSRFKDSLGNPTHILRIGESYKEK QRTIQAKKEVEQRRAGGYSRKYASKAKNLADDMVRNTARDLLYYAVTQDAMLIF ENLSRGFGRQGKRTFMAERQYTRMEDWLTAKLAYEGLSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 36) |

TABLE 4-continued

CasX Variant Sequences

| Description* | Amino Acid Sequence |
|---|---|
| NTSB, Helical I, Helical II, OBD and RuvC domains from SEQ ID NO: 2 and a TSL domain from SEQ ID NO: 1. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITTADYDGMLVRLKKTSDGWATTLNNKELKAEGQITYYNRYKRQTVEKE LSAELDRLSEESGNNDISKWTKGRRDEALFLLKKRFSHRPVQEQFVCLDCGHEV HADEQAALNIARSWLFLRSQEYKKYQTNKTTGNTDKRAFVETWQSFYRKKLKEV WKPAV (SEQ ID NO: 37) |
| TSL, Helical I, Helical II, OBD and RuvC domains from SEQ ID NO: 1 and an NTSB domain from SEQ ID NO: 2 | MEKRINKIRKKLSADNATKPVSRSGPMKTLLVRVMTDDLKKRLEKRRKKPEVMP QVISNNAANNLRMLLDDYTKMKEAILQVYWQEFKDDHVGLMCKFAQPAPKNIDQ RKLIPVKDGNERLTSSGFACSQCCQPLYVYKLEQVNDKGKPHTNYFGRCNVSEH ERLILLSPHKPEANDELVTYSLGKFGQRALDFYSIHVTKESTHPVKPLAQIAGN RYASGPVGKALSDACMGTIASFLSKYQDIIIEHQKVVKGNQKRLESLRELAGKE NLEYPSVTLPPQPHTKEGVDAYNEVIARVRMWVNLNLWQKLKLSRDDAKPLLRL KGFPSFPVVERRENEVDWWNTINEVKKLIDAKRDMGRVFWSGVTAEKRNTILEG YNYLPNENDHKKREGSLENPKKPAKRQFGDLLLYLEKKYAGDWGKVFDEAWERI DKKIAGLTSHIEREEARNAEDAQSKAVLTDWLRAKASFVLERLKEMDEKEFYAC EIQLQKWYGDLRGNPFAVEAENRVVDISGFSIGSDGHSIQYRNLLAWKYLENGK REFYLLMNYGKKGRIRFTDGTDIKKSGKWQGLLYGGGKAKVIDLTFDPDDEQLI ILPLAFGTRQGREFIWNDLLSLETGLIKLANGRVIEKTIYNKKIGRDEPALFVA LTFERREVVDPSNIKPVNLIGVDRGENIPAVIALTDPEGCPLPEFKDSSGGPTD ILRIGEGYKEKQRAIQAAKEVEQRRAGGYSRKFASKSRNLADDMVRNSARDLFY HAVTHDAVLVFENLSRGFGRQGKRTFMTERQYTKMEDWLTAKLAYEGLTSKTYL SKTLAQYTSKTCSNCGFTITTADYDGMLVRLKKTSDGWATTLNNKELKAEGQIT YYNRYKRQTVEKELSAELDRLSEESGNNDISKWTKGRRDEALFLLKKRFSHRPV QEQFVCLDCGHEVHADEQAALNIARSWLFNSNSTEFKSYKSGKQPFVGAWQAF YKRRLKEVWKPNA (SEQ ID NO: 38) |
| NTSB, Helical I, Helical II, OBD and RitvC domains from SEQ ID NO: 1 and an TSL domain from SEQ ID NO: 2. | MEKRINKIRKKLSADNATKPVSRSGPMKTLLVRVMTDDLKKRLEKRRKKPEVMP QVISNNAANNLRMLLDDYTKMKEAILQVYWQEFKDDHVGLMCKFAQPASKKIDQ NKLKPEMDEKGNLTTAGFACSQCGQPLFVYKLEQVSEKGKAYTNYFGRCNVAEH EKLILLAQLKPEKDSDEAVTYSLGKFGQRALDFYSIHVTKESTHPVKPLAQIAG NRYASGPVGKALSDACMGTIASFLSKYQDIIIEHQKVVKGNQKRLESLRELAGK ENLEYPSVTLPPQPHTKEGVDAYNEVIARVRMWVNLNLWQKLKLSRDDAKPLLR LKGFPSFPVVERRENEVDWWNTINEVKKLIDAKRDMGRVFWSGVTAEKRNTILE GYNYLPNENDHKKREGSLENPKKPAKRQFGDLLLYLEKKYAGDWGKVFDEAWER IDKKIAGLTSHIEREEARNAEDAQSKAVLTDWLRAKASFVLERLKEMDEKEFYA CEIQLQKWYGDLRGNPFAVEAENRVVDISGFSIGSDGHSIQYRNLLAWKYLENG KREFYLLMNYGKKGRIRFTDGTDIKKSGKWQGLLYGGGKAKVIDLTFDPDDEQL IILPLAFGTRQGREFIWNDLLSLETGLIKLANGRVIEKTIYNKKIGRDEPALFV ALTFERREVVDPSNIKPVNLIGVDRGENIPAVIALTDPEGCPLPEFKDSSGGPT DILRIGEGYKEKQRAIQAAKEVEQRRAGGYSRKFASKSRNLADDMVRNSARDLF YHAVTHDAVLVFENLSRGFGRQGKRTFMTERQYTKMEDWLTAKLAYEGLTSKTY LSKTLAQYTSKTCSNCGFTITSADYDRVLEKLKKTATGWMTTINGKELKVEGQI TYYNRYKRQNVVKDLSVELDRLSEESVNNDISSWTKGRSGEALSLLKKRFSHRP VQEKFVCLNCGFETHADEQAALNIARSWLFLNSNSTEFKSYKSGKQPFVGAWQA FYKRRLKEVWKPNA (SEQ ID NO: 39) |
| NTSB, TSL, Helical I, Helical II and OBD domains SEQ IDINO: 2 and an exogenous RitvC domainora portion thereof from | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR |

TABLE 4-continued

CasX Variant Sequences

| Description* | Amino Acid Sequence |
| --- | --- |
| a second CasX protein | EFIWNDLLSLETGSLKLANGRVIEKTLYNRRTRQDEPALFVALTFERREVLDSS NIKPVNLIGVDRGENIPAVIALTDPEGCPLPEFKDSSGGPTDILRIGEGYKEKQ RAIQAAKEVEQRRAGGYSRKFASKSRNLADDMVRNSARDLFYHAVTHDAVLVFE NLSRGFGRQGKRTFMTERQYTKMEDWLTAKLAYEGLTSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THA (SEQ ID NO: 40)<br><br>MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HA (SEQ ID NO: 41) |
| NTSB, TSL, Helical II, OBD and RANC domains from SEQ ID NO: 2 and a Helical I domain from SEQ ID NO: 1 | MQEIKRINKIRRRLVKDSNIKKAGKTGPMKTLLVRVMTPDLRERLENLRKKPEN IPQPISNNAANNLRMLLDDYTKMKEAILQVYWQEFKDDHVGLMCKFAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTKESTHPVKPLAQIA GNRYASGPVGKALSDACMGTIASFLSKYQDIIIEHQKVVKGNQKRLESLRELAG KENLEYPSVTLPPQPHTKEGVDAYNEVIARVRMWVNLNLWQKLKLSRDDAKPLL RLKGFPSFPLVERQANEVDWWDMVCNVKKLINEKKEDGKVFWQNLAGYKRQEAL RPYLSSEEDRKKGKKFARYQFGDLLLHLEKKHGEDWGKVVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 42) |
| NTSB, TSL, Helical I, OBD and RANC domains from SEQ ID NO: 2 and a Helical II domain from SEQ ID NO: 1 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPVVERRENEVDWWNTINEVKKLIDAKRDMGRVFWSGVTAEKRNTIL EGYNYLPNENDHKKREGSLENPKKPAKRQFGDLLLYLEKKYAGDWGKVFDEAWE RIDKKIAGLTSHIEREEARNAEDAQSKAVLTDWLRAKASFVLERLKEMDEKEFY ACEIQLQKWYGDLRGNPFAVEAENSILDISGFSKQYNCAFIWQKDGVKKLNLYL IINYFKGGKLRFKKIKPEAFEANRFYTVINKKSGEIVPMEVNFNFDDPNLIILP LAFGKRQGREFIWNDLLSLETGSLKLANGRVIEKTLYNRRTRQDEPALFVALTF ERREVLDSSNIKPMNLIGIDRGENIPAVIALTDPEGCPLSRFKDSLGNPTHILR IGESYKEKQRTIQAKKEVEQRRAGGYSRKYASKAKNLADDMVRNTARDLLYYAV TQDAMLIFENLSRGFGRQGKRTFMAERQYTRMEDWLTAKLAYEGLSKTYLSKTL AQYTSKTCSNCGFTITSADYDRVLEKLKKTATGWMTTINGKELKVEGQITYYNR YKRQNVVKDLSVELDRLSEESVNNDISSWTKGRSGEALSLLKKRFSHRPVQEKF VCLNCGFETHADEQAALNIARSWLFLRSQEYKKYQTNKTTGNTDKRAFVETWQS FYRKKLKEVWKPAV (SEQ ID NO: 43) |
| NTSB, TSL, Helical I, Helical II and RitvC domains from a first CasX protein and an exogenous | MISNTSRANLNKLLTDYTEMKKAILHVYWEEFQKDPVGLMSRVAQPAPKNIDQR KLIPVKDGNERLTSSGFACSQCCQPLYVYKLEQVNDKGKPHTNYFGRCNVSEHE RLILLSPHKPEANDELVTYSLGKFGQRALDFYSIHVTRESNHPVKPLEQIGGNS CASGPVGKALSDACMGAVASFLTKYQDIILEHQKVIKKNEKRLANLKDIASANG LAFPKITLPPQPHTKEGIEAYNNVVAQIVIWVNLNLWQKLKIGRDEAKPLQRLK GFPSFPLVERQANEVDWWDMVCNVKKLINEKKEDGKVFWQNLAGYKRQEALRPY LSSEEDRKKGKKFARYQFGDLLLHLEKKHGEDWGKVVYDEAWERIDKKVEGLSKH IKLEEERRSEDAQSKAALTDWLRAKASFVIEGLKEADKDEFCRCELKLQKWYGD LRGKPFAIEAENRVVDISGFSIGSDGHSIQYRNLLAWKYLENGKREFYLLMNYG |

95
96

TABLE 4-continued

CasX Variant Sequences

| Description* | Amino Acid Sequence |
|---|---|
| OBD or a part thereof from a second CasX protein | KKGRIRFTDGTDIKKSGKWQGLLYGGGKAKVIDLTFDPDDEQLIILPLAFGTRQ GREFIWNDLLSLETGLIKLANGRVIEKTIYNKKIGRDEPALFVALTFERREVVD PSNIKPMNLIGIDRGENIPAVIALTDPEGCPLSRFKDSLGNPTHILRIGESYKE KQRTIQAKKEVEQRRAGGYSRKYASKAKNLADDMVRNTARDLLYYAVTQDAMLI FENLSRGFGRQGKRTFMAERQYTRMEDWLTAKLAYEGLSKTYLSKTLAQYTSKT CSNCGFTITSADYDRVLEKLKKTATGWMTTINGKELKVEGQITYYNRYKRQNVV KDLSVELDRLSEESVNNDISSWTKGRSGEALSLLKKRFSHRPVQEKFVCLNCGF ETHADEQAALNIARSWLFLRSQEYKKYQTNKTTGNTDKRAFVETWQSFYRKKLK EVVWKPAV (SEQ ID NO: 44)<br><br>MEKRINKIRKKLSADNATKPVSRSGPMKTLLVRVMTDDLKKRLEKRRKKPEVMP QVISNTSRANLNKLLTDYTEMKKAILHVYWEEFQKDPVGLMSRVAQPAPKNIDQ RKLIPVKDGNERLTSSGFACSQCCQPLYVYKLEQVNDKGKPHTNYFGRCNVSEH ERLILLSPHKPEANDELVTYSLGKFGQRALDFYSIHVTRESNHPVKPLEQIGGN SCASGPVGKALSDACMGAVASFLTKYQDIILEHQKVIKKNEKRLANLKDIASAN GLAFPKITLPPQPHTKEGIEAYNNVVAQIVIWVNLNLWQKLKIGRDEAKPLQRL KGFPSFPLVERQANEVDWWDMVCNVKKLINEKKEDGKVFWQNLAGYKRQEALRP YLSSEEDRKKGKKFARYQFGDLLLHLEKKHGEDWGKVYDEAWERIDKKVEGLSK HIKLEEERRSEDAQSKAALTDWLRAKASFVIEGLKEADKDEFCRCELKLQKWYG DLRGKPFAIEAENSILDISGFSKQYNCAFIWQKDGVKKLNLYLIINYFKGGKLR FKKIKPEAFEANRFYTVINKKSGEIVPMEVNFNFDDPNLIILPLAFGKRQGREF IWNDLLSLETGSLKLANGRVIEKTLYNRRTRQDEPALFVALTFERREVLDSSNI KPMNLIGIDRGENIPAVIALTDPEGCPLSRFKDSLGNPTHILRIGESYKEKQRT IQAKKEVEQRRAGGYSRKYASKAKNLADDMVRNTARDLLYYAVTQDAMLIFENL SRGFGRQGKRTFMAERQYTRMEDWLTAKLAYEGLSKTYLSKTLAQYTSKTCSNC GFTITSADYDRVLEKLKKTATGWMTTINGKELKVEGQITYYNRYKRQNVVKDLS VELDRLSEESVNNDISSWTKGRSGEALSLLKKRFSHRPVQEKFVCLNCGFETHA DEQAALNIARSWLFLRSQEYKKYQTNKTTGNTDKRAFVETWQSFYRKKLKEVWK PAV (SEQ ID NO: 45)<br><br>MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENRVVDISGFSIGSDGHSIQYRNLLAWKYLENGKREFYLLM NYGKKGRIRFTDGTDIKKSGKWQGLLYGGGKAKVIDLTFDPPDEQLIILPLAFG TRQGREFIWNDLLSLETGLIKLANGRVIEKTIYNKKIGRDEPALFVALTFERRE VVDPSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYYAVTQDA MLIFENLSRGFGRQGKRTFMAERQYTRMEDWLTAKLAYEGLSKTYLSKTLAQYT SKTCSNCGFTITSADYDRVLEKLKKTATGWMTTINGKELKVEGQITYYNRYKRQ NVVKDLSVELDRLSEESVNNDISSWTKGRSGEALSLLKKRFSHRPVQEKFVCLN CGFETHADEQAALNIARSWLFLRSQEYKKYQTNKTTGNTDKRAFVETWQSFYRK KLKEVWKPAV (SEQ ID NO: 46) |
| substitution of L379R, a substitution of C477K, a substitution of A708K, a deletion of P at position 793 and a substitution of T620P of SEQ ID NO: 2 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFKRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKPLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 47) |
| substitution of M771A of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ |

TABLE 4-continued

CasX Variant Sequences

| Description* | Amino Acid Sequence |
|---|---|
| | RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFAAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPA (SEQ ID NO: 48) |
| substitution<br>of L379R, a<br>substitution<br>of A708K, a<br>deletion of P<br>at position<br>793 and a<br>substitution<br>of D732N of<br>SEQ ID NO:<br>2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 49) |
| substitution<br>of W782Q of<br>SEQ ID NO:<br>2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFMAERQYTRMEDQLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 50) |
| substitution<br>of M771Q of<br>SEQ ID NO:<br>2 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFQAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 51) |

TABLE 4-continued

CasX Variant Sequences

| Description* | Amino Acid Sequence |
|---|---|
| substitution of R458I and a substitution of A739V of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSEEDRKKGKKFARYQFGDLLLHLEKKHGEDWGKVYDEAWERIDKKVEGL SKHIKLEEERRSEDAQSKAALTDWLIAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAAKEVEQRRAGGYSRKYASKAKNLADDMVRNTVRDLLYYAVTQDAMLIFE NLSRGFGRQGKRTFMAERQYTRMEDWLTAKLAYEGLPSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 52) |
| L379R, a substitution of A708K, a deletion of P at position 793 and a substitution of M771N of SEQ ID NO: 2 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFNAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 53) |
| substitution of L379R, a substitution of A708K, a deletion of P at position 793 and a substitution of A739T of SEQ ID NO: 2 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTTRDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 54) |
| substitution of L379R, a substitution of C477K, a substitution of A708K, a deletion of P at position 793 and a substitution of D489S of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGSLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS |

TABLE 4-continued

CasX Variant Sequences

| Description* | Amino Acid Sequence |
|---|---|
| | NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 55) |
| substitution of L379R, a substitution of C477K, a substitution of A708K, a deletion of P at position 793 and a substitution of D732N of SEQ ID NO: 2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 56) |
| substitution of V711K of SEQ ID NO: 2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKEKEQRRAGGYSRKYASKAKNLADDMVRNTARDLLYYAVTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 57) |
| substitution of L379R, a substitution of C477K, a substitution of A708K, a deletion of P at position 793 and a substitution of Y797L of SEQ ID NO: 2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 58) |
| 119: substitution of L379R, a substitution of A708K and a deletion of P | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL |

TABLE 4-continued

CasX Variant Sequences

| Description* | Amino Acid Sequence |
|---|---|
| at position 793 of SEQ ID NO: 2. | RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 59) |
| substitution of L379R, a substitution of C477K, a substitution of A708K, a deletion of P at position 793 and a substitution of M771N of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFNAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 60) |
| substitution of A708K, a deletion of P at position 793 and a substitution of E386S of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSESDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 61) |
| substitution of L379R, a substitution of C477K, a substitution of A708K and a deletion of P at position 793 of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 62) |

TABLE 4-continued

CasX Variant Sequences

| Description* | Amino Acid Sequence |
| --- | --- |
| substitution of L792D of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAAKEVEQRRAGGYSRKYASKAKNLADDMVRNTARDLLYYAVTQDAMLIFE NLSRGFGRQGKRTFMAERQYTRMEDWLTAKLAYEGDPSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 63) |
| substitution of G791F of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAAKEVEQRRAGGYSRKYASKAKNLADDMVRNTARDLLYYAVTQDAMLIFE NLSRGFGRQGKRTFMAERQYTRMEDWLTAKLAYEFLPSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 64) |
| substitution of A708K, a deletion of P at position 793 and a substitution of A739V of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTVRDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 65) |
| substitution of L379R, a substitution of A708K, a deletion of P at position 793 and a substitution of A739V of SEQ ID NO: 2. | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAAKEVEQRRAGGYSRKYASKAKNLADDMVRNTVRDLLYYAVTQDAMLIFE NLSRGFGRQGKRTFMAERQYTRMEDWLTAKLAYEGLSKTYLSKTLAQYTSKTCS |

TABLE 4-continued

CasX Variant Sequences

| Description* | Amino Acid Sequence |
|---|---|
| | NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGPET<br>HADEQAALNIARSWLFLRSQEYKKYQTNKTTGNTDKRAFVETWQSFYRKKLKEV<br>WKPAV (SEQ ID NO: 66) |
| substitution of C477K, a substitution of A708K and a deletion of P at position 793 of SEQ ID NO: 2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGPET<br>HADEQAALNIARSWLFLRSQEYKKYQTNKTTGNTDKRAFVETWQSFYRKKLKEV<br>WKPAV (SEQ ID NO: 67) |
| substitution of L249I and a substitution of M771N of 2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFNAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 68) |
| substitution of V747K of SEQ ID NO: 2. | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAKTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 69) |
| substitution of L379R, a substitution of C477K, a substitution of A708K, a deletion of P at position | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL |

TABLE 4-continued

CasX Variant Sequences

| Description* | Amino Acid Sequence |
|---|---|
| 793 and a substitution of M779N of SEQ ID NO: 2. | SKHIKLEEERRSEDAQSKAALTDWLRAKASFVIEGLKEADKDEFKRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRNEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 70) |
| L379R, F755M | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAAKEVEQRRAGGYSRKYASKAKNLADDMVRNTARDLLYYAVTQDAMLIME NLSRGFGRQGKRTFMAERQYTRMEDWLTAKLAYEGLPSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 71) |
| 429: L379R, A708K, P793_, Y857R | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRRKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 72) |
| 430 L379R, A708K, P793_, Y857R, I658V | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGVDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRRKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 73) |
| 431 L379R, A708K, P793_, | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG |

TABLE 4-continued

CasX Variant Sequences

| Description* | Amino Acid Sequence |
|---|---|
| Y857R,<br>I658V,<br>E386N | GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 74) |
| 432<br>L379R,<br>A708K,<br>P793_,<br>Y857R,<br>I658V,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 75) |
| 433<br>L379R,<br>A708K,<br>P793_,<br>Y857R,<br>I658V,<br>^V192 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQVRALDFYSIHVTRESNHPVKPLEQI<br>GGNSCASGPVGKALSDACMGAVASFLTKYQDIILEHQKVIKKNEKRLANLKDIA<br>SANGLAFPKITLPPQPHTKEGIEAYNNVVAQIVIWVNLNLWQKLKIGRDEAKPL<br>QRLKGFPSFPLVERQANEVDWWDMVCNVKKLINEKKEDGKVFWQNLAGYKRQEA<br>LRPYLSSEEDRKKGKKFARYQFGDLLLHLEKKHGEDWGKVYDEAWERIDKKVEG<br>LSKHIKLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYFKGG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGVDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRRKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 76) |
| 434<br>L379R,<br>A708K,<br>P793_,<br>Y857R,<br>I658V,<br>L404K,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 77) |

TABLE 4-continued

CasX Variant Sequences

| Description* | Amino Acid Sequence |
|---|---|
| 435<br>L379R,<br>A708K,<br>P793_,<br>Y857R,<br>I658V,<br>F399L | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 78) |
| 436<br>L379R,<br>A708K,<br>P793_,<br>Y857R,<br>I658V,<br>F399L,<br>E386N | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 79) |
| 437<br>L379R,<br>A708K,<br>P793_,<br>Y857R,<br>I658V,<br>F399L,<br>C477S | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 80) |
| 438:<br>L379R,<br>A708K,<br>P793_,<br>Y857R,<br>I658V,<br>F399L,<br>L404K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD |

TABLE 4-continued

CasX Variant Sequences

| Description* | Amino Acid Sequence |
|---|---|
| | LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 81) |
| 439:<br>L379R,<br>A708K,<br>P793_,<br>Y857R,<br>I658V,<br>F399L,<br>E386N,<br>C477S,<br>L404K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQLGDLLKHLEKKHGEDWGKVYDEAWERIDKKVEGL<br>SKHIKLEEERRSEDAQSKAALTDWLRAKASFVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 82) |
| 440<br>L379R,<br>A708K,<br>P793_,<br>N857R,<br>I658V,<br>F399L,<br>Y797L | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 83) |
| 441<br>L379R,<br>A708K,<br>P793_,<br>Y857R,<br>I658V,<br>F399L,<br>Y797L,<br>E386N | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 84) |
| 442<br>L379R,<br>A708K,<br>P793_,<br>Y857R,<br>I658V,<br>F399L,<br>Y797L, | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQLGDLLKHLEKKHGEDWGKVYDEAWERIDKKVEGL |

TABLE 4-continued

CasX Variant Sequences

| Description* | Amino Acid Sequence |
|---|---|
| E386N,<br>C477S,<br>L404K | SKHIKLEEERRSEDAQSKAALTDWLRAKASFVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 85) |
| 443<br>L379R,<br>A708K,<br>P793_,<br>Y857L<br>I658V,<br>Y797L | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 86) |
| 444<br>L379R,<br>A708K,<br>P793_,<br>Y857R,<br>I658V,<br>Y797L,<br>L404K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 87) |
| 445<br>L379R,<br>A708K,<br>P793_,<br>Y857R,<br>I658V,<br>Y797L,<br>E386N | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 88) |
| 446<br>L379R,<br>A708K,<br>P793_, | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG |

TABLE 4-continued

CasX Variant Sequences

| Description* | Amino Acid Sequence |
|---|---|
| Y857R,<br>I658V,<br>Y797L,<br>E386N,<br>C477S,<br>L404K | GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLKHLEKKHGEDWGKVYDEAWERIDKKVEGL<br>SKHIKLEEERRSEDAQSKAALTDWLRAKASFVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKILLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 89) |
| 447<br>L379R,<br>A708K,<br>P793_,<br>Y857R,<br>E386N | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 90) |
| 448:<br>L379R,<br>A708K,<br>P793_,<br>Y857R,<br>E386N,<br>L404K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 91) |
| 449:<br>L379R,<br>A708K,<br>P793_,<br>D732N,<br>E385P,<br>Y857R | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 92) |

TABLE 4-continued

CasX Variant Sequences

| Description* | Amino Acid Sequence |
| --- | --- |
| 450<br>L379R,<br>A708K,<br>P793_,<br>D732N,<br>E385P,<br>Y857R,<br>I658V | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 93) |
| 451:<br>L379R,<br>A708K,<br>P793_,<br>D732N,<br>E385P,<br>Y857R,<br>I658V,<br>F399L | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 94) |
| 452<br>L379R,<br>A708K,<br>P793_,<br>D732N,<br>E385P,<br>Y857R,<br>I658V,<br>E386N | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPNDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 95) |
| 453<br>L379R,<br>A708K,<br>P793_,<br>D732N,<br>E385P,<br>Y857R,<br>I658V,<br>L404K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD |

TABLE 4-continued

CasX Variant Sequences

| Description* | Amino Acid Sequence |
|---|---|
| | LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 96) |
| 454<br>L379R,<br>A708K,<br>P793_,<br>T620P,<br>E385P,<br>Y857R,<br>Q252K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 97) |
| 455<br>L379R,<br>A708K,<br>P793_,<br>T620P,<br>E385P,<br>Y857R,<br>I658V,<br>Q252K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 98) |
| 456<br>L379R,<br>A708K,<br>P793_,<br>T620P,<br>E385P,<br>Y857R,<br>I658V,<br>E386N,<br>Q252K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPNDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 99) |
| 457<br>L379R,<br>A708K,<br>P793_,<br>T620P,<br>E385P,<br>Y857R,<br>I658V,<br>F399L,<br>Q252K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS |

TABLE 4-continued

CasX Variant Sequences

| Description* | Amino Acid Sequence |
|---|---|
| | NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 101) |
| 458:<br>L379R,<br>A708K,<br>P793_,<br>T620P,<br>E385P,<br>Y857R,<br>I658V,<br>L404K,<br>Q252K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 102) |
| 459:<br>L379R,<br>A708K,<br>P793_,<br>T620P,<br>Y857R,<br>I658V,<br>E386N | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 103) |
| 460:<br>L379R,<br>A708K,<br>P793_,<br>T620P,<br>E385P,<br>Q252K | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 104) |
| 278 | QEIKRINKIRRRLVKDSNIKKAGKTGPMKTLLVRVMTPDLRERLENLRKKPENI<br>PQPISNTSRANLNKLLTDYTEMKKAILHVYWEEFQKDPVGLMSRVAQPAPKNID<br>QRKLIPVKDGNERLTSSGFACSQCCQPLYVYKLEQVNDKGKPHTNYFGRCNVSE<br>HERLILLSPHKPEANDELVTYSLGKFGQRALDFYSIHVTRESNHPVKPLEQIGG<br>NSCASGPVGKALSDACMGAVASFLTKYQDIILEHQKVIKKNEKRLANLKDIASA<br>NGLAFPKITLPPQPHTKEGIEAYNNVVAQIVIWVNLNLWQKLKIGRDEAKPLQR<br>LKGFPSFPLVERQANEVDWWDMVCNVKKLINEKKEDGKVFWQNLAGYKRQEALR<br>PYLSSEEDRKKGKKFARYQFGDLLLHLEKKHGEDWGKVYDEAWERIDKKVEGLS |

TABLE 4-continued

CasX Variant Sequences

| Description* | Amino Acid Sequence |
|---|---|
| | KHIKLEEERRSEDAQSKAALTDWLRAKASFVIEGLKEADKEFCRCELKLQKWY GDLRGKPFAIEAENSILDISGFSKQYNCAFIWQKDGVKKLNLYLIINYFKGGKL RFKKIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVLDSSN IKPMNLIGIDRGENIPAVIALTDPEGCPLSRFKDSLGNPTHILRIGESYKEKQR TIQAKKEVEQRRAGGYSRKYASKAKNLADDMVRNTARDLLYYAVTQDAMLIFEN LSRGFGRQGKRTFMAERQYTRMEDWLTAKLAYEGLSKTYLSKTLAQYTSKTCSN CGFTITSADYDRVLEKLKKTATGWMTTINGKELKVEGQITYYNRYKRQNVVKDL SVELDRLSEESVNNDISSWTKGRSGEALSLLKKRFSHRPVQEKFVCLNCGFETH ADEQAALNIARSWLFLRSQEYKKYQTNKTTGNTDKRAFVETWQSFYRKKLKEVW KPAV (SEQ ID NO: 105) |
| 279 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 106) |
| 280 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 107) |
| 285 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 108) |
| 286 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG |

TABLE 4-continued

CasX Variant Sequences

| Description* | Amino Acid Sequence |
| --- | --- |
| | GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 109) |
| 287 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 110) |
| 288 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTMSSGFACSQCCQPLYVYKLEQVNDKGKPHTNYFGRCNV<br>SEHERLILLSPHKPEANDELVTYSLGKFGQRALDFYSIHVTRESNHPVKPLEQI<br>GGNSCASGPVGKALSDACMGAVASFLTKYQDIILEHQKVIKKNEKRLANLKDIA<br>SANGLAFPKITLPPQPHTKEGIEAYNNVVAQIVIWVNLNLWQKLKIGRDEAKPL<br>QRLKGFPSFPLVERQANEVDWWDMVCNVKKLINEKKEDGKVFWQNLAGYKRQEA<br>LRPYLSSEEDRKKGKKFARYQFGDLLLHLEKKHGEDWGKVYDEAWERIDKKVEG<br>LSKHIKLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYFKGG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGIDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 111) |
| 290 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 112) |

TABLE 4-continued

CasX Variant Sequences

| Description* | Amino Acid Sequence |
|---|---|
| 291 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 113) |
| 293 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 114) |
| 300 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 115) |
| 492 | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD |

TABLE 4-continued

CasX Variant Sequences

| Description* | Amino Acid Sequence |
|---|---|
| | LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 116) |
| 493 | MQEIKRINKIRRRLVKDSNIKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 117) |
| 387:<br>NTSB swap<br>from SEQ ID<br>NO: 1 | QEIKRINKIRRRLVKDSNIKKAGKTGPMKTLLVRVMTPDLRERLENLRKKPENI PQPISNTSRANLNKLLTDYTEMKKAILHVYWEEFQKDPVGLMSRVAQPASKKID QNKLKPEMDEKGNLTTAGFACSQCGQPLFVYKLEQVSEKGKAYTNYFGRCNVAE HEKLILLAQLKPEKDSDEAVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 118) |
| 395:<br>Helical 1B<br>swap from<br>SEQ ID NO:<br>1 | QEIKRINKIRRRLVKDSNIKKAGKTGPMKTLLVRVMTPDLRERLENLRKKPENI PQPISNTSRANLNKLLTDYTEMKKAILHVYWEEFQKDPVGLMSRVAQPAPKNID QRKLIPVKDGNERLTSSGFACSQCCQPLYVYKLEQVNDKGKPHTNYFGRCNVSE HERLILLSPHKPEANDELVTYSLGKFGQRALDFYSIHVTKESTHPVKPLAQIAG NRYASGPVGKALSDACMGTIASFLSKYQDIIIEHQKVVKGNQKRLESLRELAGK ENLEYPSVTLPPQPHTKEGVDAYNEVIARVRMWVNLNLWQKLKLSRDDAKPLLR LKGFPSFPLVERQANEVDWWDMVCNVKKLINEKKEDGKVFWQNLAGYKRQEALR PYLSSEEDRKKGKKFARYQFGDLLLHLEKKHGEDWGKVYDEAWERIDKKVEGLS KHIKLEEERRSEDAQSKAALTDWLRAKASFVIEGLKEADKDEFCRCELKLQKWY GDLRGKPFAIEAENSILDISGFSKQYNCAFIWQKDGVKKLNLYLIINYFKGGKL RFKKIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVLDSSN IKPMNLIGIDRGENIPAVIALTDPEGCPLSRFKDSLGNPTHILRIGESYKEKQR TIQAKKEVEQRRAGGYSRKYASKAKNLADDMVRNTARDLLYYAVTQDAMLIFEN LSRGFGRQGKRTFMAERQYTRMEDWLTAKLAYEGLSKTYLSKTLAQYTSKTCSN CGFTITSADYDRVLEKLKKTATGWMTTINGKELKVEGQITYYNRYKRQNVVKDL SVELDRLSEESVNNDISSWTKGRSGEALSLLKKRFSHRPVQEKFVCLNCGFETH ADEQAALNIARSWLFLRSQEYKKYQTNKTTGNTDKRAFVETWQSFYRKKLKEVW KPAV (SEQ ID NO: 119) |
| 485:<br>Helical 1B<br>swap from<br>SEQ ID NO:<br>1 | QEIKRINKIRRRLVKDSNTKKAGKTGPMKTLLVRVMTPDLRERLENLRKKPENI PQPISNTSRANLNKLLTDYTEMKKAILHVYWEEFQKDPVGLMSRVAQPAPKNID QRKLIPVKDGNERLTSSGFACSQCCQPLYVYKLEQVNDKGKPHTNYFGRCNVSE HERLILLSPHKPEANDELVTYSLGKFGQRALDFYSIHVTKESTHPVKPLAQIAG NRYASGPVGKALSDACMGTIASFLSKYQDIIIEHQKVVKGNQKRLESLRELAGK ENLEYPSVTLPPQPHTKEGVDAYNEVIARVRMWVNLNLWQKLKLSRDDAKPLLR LKGFPSFPLVERQANEVDWWDMVCNVKKLINEKKEDGKVFWQNLAGYKRQEALR PYLSSEEDRKKGKKFARYQLGDLLLHLEKKHGEDWGKVYDEAWERIDKKVEGLS KHIKLEEERRSEDAQSKAALTDWLRAKASFVIEGLKEADKDEFCRCELKLQKWY GDLRGKPFAIEAENSILDISGFSKQYNCAFIWQKDGVKKLNLYLIINYFKGGKL RFKKIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVLDSSN |

TABLE 4-continued

CasX Variant Sequences

| Description* | Amino Acid Sequence |
|---|---|
| | IKPMNLIGVDRGENIPAVIALTDPEGCPLSRFKDSLGNPTHILRIGESYKEKQR
TIQAKKEVEQRRAGGYSRKYASKAKNLADDMVRNTARDLLYYAVTQDAMLIFEN
LSRGFGRQGKRTFMAERQYTRMEDWLTAKLAYEGLSKTYLSKTLAQYTSKTCSN
CGFTITSADYDRVLEKLKKTATGWMTTINGKELKVEGQITYYNRRKQNVVKDL
SVELDRLSEESVNNDISSWTKGRSGEALSLLKKRFSHRPVQEKFVCLNCGFETH
ADEQAALNIARSWLFLRSQEYKKYQTNKTTGNTDKRAFVETWQSFYRKKLKEVW
KPAV (SEQ ID NO: 120) |
| 486:
Helical 1B
swap from
SEQ ID NO:
1 | QEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPAPKNID
QRKLIPVKDGNERLTSSGFACSQCCQPLYVYKLEQVNDKGKPHTNYFGRCNVSE
HERLILLSPHKPEANDELVTYSLGKFGQRALDFYSIHVTKESTHPVKPLAQIAG
NRYASGPVGKALSDACMGTIASFLSKYQDIIIEHQKVVKGNQKRLESLRELAGK
ENLEYPSVTLPPQPHTKEGVDAYNEVIARVRMWVNLNLWQKLKLSRDDAKPLLR
LKGFPSFPLVERQANEVDWWDMVCNVKKLINEKKEDGKVFWQNLAGYKRQEALR
PYLSSEEDRKKGKKFARYQLGDLLKHLEKKHGEDWGKVYDEAWERIDKKVEGLS
KHIKLEEERRSEDAQSKAALTDWLRAKASFVIEGLKEADKDEFCRCELKLQKWY
GDLRGKPFAIEAENSILDISGFSKQYNCAFIWQKDGVKKLNLYLIINYFKGGKL
RFKKIKPEAFEANRFYTVINKKSGEIVPMEVNFNFDDPNLIILPLAFGKRQGRE
FIWNDLLSLETGSLKLANGRVIEKTLYNRRTRQDEPALFVALTFERREVLDSSN
IKPMNLIGVDRGENIPAVIALTDPEGCPLSRFKDSLGNPTHILRIGESYKEKQR
TIQAKKEVEQRRAGGYSRKYASKAKNLADDMVRNTARDLLYYAVTQDAMLIFEN
LSRGFGRQGKRTFMAERQYTRMEDWLTAKLAYEGLSKTYLSKTLAQYTSKTCSN
CGFTITSADYDRVLEKLKKTATGWMTTINGKELKVEGQITYYNRRKQNVVKDL
SVELDRLSEESVNNDISSWTKGRSGEALSLLKKRFSHRPVQEKFVCLNCGFETH
ADEQAALNIARSWLFLRSQEYKKYQTNKTTGNTDKRAFVETWQSFYRKKLKEVW
KPAV (SEQ ID NO: 121) |
| 487:
Helical 1B
swap from
SEQ ID
1 | QEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPAPKNID
QRKLIPVKDGNERLTSSGFACSQCCQPLYVYKLEQVNDKGKPHTNYFGRCNVSE
HERLILLSPHKPEANDELVTYSLGKFGQRALDFYSIHVTKESTHPVKPLAQIAG
NRYASGPVGKALSDACMGTIASFLSKYQDIIIEHQKVVKGNQKRLESLRELAGK
ENLEYPSVTLPPQPHTKEGVDAYNEVIARVRMWVNLNLWQKLKLSRDDAKPLLR
LKGFPSFPLVERQANEVDWWDMVCNVKKLINEKKEDGKVFWQNLAGYKRQEALR
PYLSSEEDRKKGKKFARYQLGDLLLHLEKKHGEDWGKVYDEAWERIDKKVEGLS
KHIKLEEERRSEDAQSKAALTDWLRAKASFVIEGLKEADKDEFCRCELKLQKWY
GDLRGKPFAIEAENSILDISGFSKQYNCAFIWQKDGVKKLNLYLIINYFKGGKL
RFKKIKPEAFEANRFYTVINKKSGEIVPMEVNFNFDDPNLIILPLAFGKRQGRE
FIWNDLLSLETGSLKLANGRVIEKTLYNRRTRQDEPALFVALTFERREVLDSSN
IKPMNLIGVDRGENIPAVIALTDPEGCPLSRFKDSLGNPTHILRIGESYKEKQR
TIQAKKEVEQRRAGGYSRKYASKAKNLADDMVRNTARDLLYYAVTQDAMLIFEN
LSRGFGRQGKRTFMAERQYTRMEDWLTAKLAYEGLSKTYLSKTLAQYTSKTCSN
CGFTITSADYDRVLEKLKKTATGWMTTINGKELKVEGQITYYNRYKRQNVVKDL
SVELDRLSEESVNNDISSWTKGRSGEALSLLKKRFSHRPVQEKFVCLNCGFETH
ADEQAALNIARSWLFLRSQEYKKYQTNKTTGNTDKRAFVETWQSFYRKKLKEVW
KPAV (SEQ ID NO: 122) |
| 488:
NTSB and
Helical 1B
swap from
SEQ ID NO:
1 | QEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPAPKNID
QNKLKPEMDEKGNLTTAGFACSQCGQPLFVYKLEQVSEKGKAYTNYFGRCNVAE
HEKLILLAQLKPEKDSDEAVTYSLGKFGQRALDFYSIHVTKESTHPVKPLAQIA
GNRYASGPVGKALSDACMGTIASFLSKYQDIIIEHQKVVKGNQKRLESLRELAG
KENLEYPSVTLPPQPHTKEGVDAYNEVIARVRMWVNLNLWQKLKLSRDDAKPLL
RLKGFPSFPLVERQANEVDWWDMVCNVKKLINEKKEDGKVFWQNLAGYKRQEAL
RPYLSSEEDRKKGKKFARYQFGDLLLHLEKKHGEDWGKVYDEAWERIDKKVEGL
SKHIKLEEERRSEDAQSKAALTDWLRAKASFVIEGLKEADKDEFCRCELKLQKW
YGDLRGKPFAIEAENSILDISGFSKQYNCAFIWQKDGVKKLNLYLIINYFKGGK
LRFKKIKPEAFEANRFYTVINKKSGEIVPMEVNFNFDDPNLIILPLAFGKRQGR
EFIWNDLLSLETGSLKLANGRVIEKTLYNRRTRQDEPALFVALTFERREVLDSS
NIKPMNLIGIDRGENIPAVIALTDPEGCPLSRFKDSLGNPTHILRIGESYKEKQ
RTIQAKKEVEQRRAGGYSRKYASKAKNLADDMVRNTARDLLYYAVTQDAMLIFE
NLSRGFGRQGKRTFMAERQYTRMEDWLTAKLAYEGLSKTYLSKTLAQYTSKTCS
NCGFTITSADYDRVLEKLKKTATGWMTTINGKELKVEGQITYYNRYKRQNVVKD
LSVELDRLSEESVNNDISSWTKGRSGEALSLLKKRFSHRPVQEKFVCLNCGFET
HADEQAALNIARSWLFLRSQEYKKYQTNKTTGNTDKRAFVETWQSFYRKKLKEV
WKPAV (SEQ ID NO: 123) |
| 489:
NTSB and
Helical 1B
swap from
SEQ ID NO:
1 | QEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPASKKID
QNKLKPEMDEKGNLTTAGFACSQCGQPLFVYKLEQVSEKGKAYTNYFGRCNVAE
HEKLILLAQLKPEKDSDEAVTYSLGKFGQRALDFYSIHVTKESTHPVKPLAQIA
GNRYASGPVGKALSDACMGTIASFLSKYQDIIIEHQKVVKGNQKRLESLRELAG
KENLEYPSVTLPPQPHTKEGVDAYNEVIARVRMWVNLNLWQKLKLSRDDAKPLL
RLKGFPSFPLVERQANEVDWWDMVCNVKKLINEKKEDGKVFWQNLAGYKRQEAL
RPYLSSEEDRKKGKKFARYQLGDLLLHLEKKHGEDWGKVYDEAWERIDKKVEGL |

TABLE 4-continued

CasX Variant Sequences

| Description* | Amino Acid Sequence |
|---|---|
| | SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 124) |
| 490:<br>NTSB and<br>Helical 1B<br>swap from<br>SEQ ID NO:<br>1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 125) |
| 491:<br>NTSB and<br>Helical 1B<br>swap from<br>SEQ ID NO:<br>1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 126) |
| 494:<br>NTSB swap<br>from SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 127) |
| 328: S867G | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG |

TABLE 4-continued

CasX Variant Sequences

| Description* | Amino Acid Sequence |
|---|---|
| | GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLGVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 128) |
| 388:<br>L379R + A708K +<br>+ [P793] +<br>X1<br>Helical2<br>swap | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPVVERRENEVDWWNTINEVKKLIDAKRDMGRVFWSGVTAEKRNTIL<br>EGYNYLPNENDHKKREGSLENPKKPAKRQFGDLLLYLEKKYAGDWGKVFDEAWE<br>RIDKKIAGLTSHIEREEARNAEDAQSKAVLTDWLRAKASFVLERLKEMDEKEFY<br>ACEIQLQKWYGDLRGNPPFAVEAENSILDISGFSKQYNCAFIWQKDGVKKLNYL<br>IINYFKGGKLRFKKIKPEAFEANRFYTVINKKSGEIVPMEVNFNFDDPNLIILP<br>LAFGKRQGREFIWNDLLSLETGSLKLANGRVIEKTLYNRRTRQDEPALFVALTF<br>ERREVLDSSNIKPMNLIGIDRGENIPAVIALTDPEGCPLSRFKDSLGNPTHILR<br>IGESYKEKQRTIQAKKEVEQRRAGGYSRKYASKAKNLADDMVRNTARDLLYYAV<br>TQDAMLIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQITYYNR<br>YKRQNVVKDLSVELDRLSEESVNNDISSWTKGRSGEALSLLKKRFSHRPVQEKF<br>VCLNCGFETHADEQAALNIARSWLFLRSQEYKKYQTNKTTGNTDKRAFVETWQS<br>FYRKKLKEVWKPAV (SEQ ID NO: 129) |
| 389:<br>L379R + A708K +<br>+ [P793] +<br>X1 RuvC1<br>swap | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPVNLIGVDRGENIPAVIALTDPEGCPLPEFKDSSGGPTDILRIGEGYKEKQ<br>RAIQAAKEVEQRRAGGYSRKFASKSRNLADDMVRNSARDLFYHAVTHDAVLVFE<br>NLSRGFGRQGKRTFMTERQYTKMEDWLTAKLAYEGLTSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 130) |
| 390:<br>L379R + A708K +<br>[P793] +<br>X1 RuvC2<br>swap | MQEIKRINKIRRRLVKDSNIKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLNSNSTEFKSYKSGKQPFVGAWQAFYKRRLKEVWKPNA<br>(SEQ ID NO: 131) |

In some embodiments, the CasX variant protein comprises a sequence selected from the group consisting of SEQ ID NOs: 36-131, 208, 210, 212, 214, 216-229, 240, 242, 244, 246, 248, 250, 252, 254, 256 and 258, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto. In some embodiments, the CasX variant protein comprises a sequence selected from the group consisting of SEQ ID NOs: 36-131, 208, 210, 212, 214, 216-229, 240, 242, 244, 246, 248, 250, 252, 254, 256 and 258. In some embodiments, the CasX variant protein comprises a sequence selected from the group consisting of SEQ ID NOs: 36-131, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto. In some embodiments, the CasX variant protein comprises a sequence selected from the group consisting of SEQ ID NOs: 36-131.

In some embodiments, the CasX variant protein has one or more improved characteristic of the CasX protein when compared to a reference CasX protein, for example a reference protein of SEQ ID NO: 1, SEQ ID NO: 2 or SEQ ID NO: 3. In some embodiments, the at least one improved characteristic of the CasX variant is at least about 1.1 to about 100,000-fold improved relative to the reference protein. In some embodiments, the at least one improved characteristic of the CasX variant is at least about 1.1 to about 10,000-fold improved, at least about 1.1 to about 1,000-fold improved, at least about 1.1 to about 500-fold improved, at least about 1.1 to about 400-fold improved, at least about 1.1 to about 300-fold improved, at least about 1.1 to about 200-fold improved, at least about 1.1 to about 100-fold improved, at least about 1.1 to about 50-fold improved, at least about 1.1 to about 40-fold improved, at least about 1.1 to about 30-fold improved, at least about 1.1 to about 20-fold improved, at least about 1.1 to about 10-fold improved, at least about 1.1 to about 9-fold improved, at least about 1.1 to about 8-fold improved, at least about 1.1 to about 7-fold improved, at least about 1.1 to about 6-fold improved, at least about 1.1 to about 5-fold improved, at least about 1.1 to about 4-fold improved, at least about 1.1 to about 3-fold improved, at least about 1.1 to about 2-fold improved, at least about 1.1 to about 1.5-fold improved, at least about 1.5 to about 3-fold improved, at least about 1.5 to about 4-fold improved, at least about 1.5 to about 5-fold improved, at least about 1.5 to about 10-fold improved, at least about 5 to about 10-fold improved, at least about 10 to about 20-fold improved, at least 10 to about 30-fold improved, at least 10 to about 50-fold improved or at least 10 to about 100-fold improved than the reference CasX protein. In some embodiments, the at least one improved characteristic of the CasX variant is at least about 10 to about 1000-fold improved relative to the reference CasX protein.

In some embodiments, the one or more improved characteristics of the CasX variant protein is at least about 5, at least about 10, at least about 20, at least about 30, at least about 40, at least about 50, at least about 60, at least about 70, at least about 80, at least about 90, at least about 100, at least about 250, at least about 500, or at least about 1000, at least about 5,000, at least about 10,000, or at least about 100,000-fold improved relative to a reference CasX protein. In some embodiments, an improved characteristics of the CasX variant protein is at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, at least about 15, at least about 20, at least about 30, at least about 40, at least about 50, at least about 60, at least about 70, at least about 80, at least about 90 at least about 100, at least about 500, at least about 1,000, at least about 10,000, or at least about 100,000-fold improved relative to a reference CasX protein. In other cases, the one or more improved characteristics of the CasX variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference CasX of SEQ ID NO: 1, SEQ ID NO: 2 or SEQ ID NO: 3. In other cases, the one or more improved characteristics of the CasX variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold or more improved relative to the reference CasX of SEQ ID NO: 1, SEQ ID NO: 2 or SEQ ID NO: 3. Exemplary characteristics that can be improved in CasX variant proteins relative to the same characteristics in reference CasX proteins include, but are not limited to, improved folding of the variant, improved binding affinity to the gNA, improved binding affinity to the target DNA, improved ability to utilize a greater spectrum of PAM sequences in the editing and/or binding of target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved CasX:gNA RNA complex stability, improved protein solubility, improved CasX:gNA RNP complex solubility, improved protein yield, improved protein expression, and improved fusion characteristics. In some embodiments, the variant comprises at least one improved characteristic. In other embodiments, the variant comprises at least two improved characteristics. In further embodiments, the variant comprises at least three improved characteristics. In some embodiments, the variant comprises at least four improved characteristics. In still further embodiments, the variant comprises at least five, at least six, at least seven, at least eight, at least nine, at least ten, at least eleven, at least twelve, at least thirteen, or more improved characteristics.

Exemplary improved characteristic include, as one example, improved editing efficiency. In some embodiments, an RNP comprising the CasX protein and a gNA of the disclosure, at a concentration of 20 pM or less, is capable of cleaving a double stranded DNA target with an efficiency of at least 80%. In some embodiments, the RNP at a concentration of 20 pM or less, is capable of cleaving a double stranded DNA target with an efficiency of at least 40%, at least 50%, at least 60%, at least 70%, at least 80%, at least 85%, at least 90% or at least 95%. In some embodiments, the RNP at a concentration of 50 pM or less, 40 pM or less, 30 pM or less, 20 pM or less, 10 pM or less, or 5 pM or less, is capable of cleaving a double stranded DNA target with an efficiency of at least 40%, at least 50%, at least 60%, at least 70%, at least 80%, at least 85%, at least 90% or at least 95%.

Further improved characteristics are described in more detail below.

j. Protein Stability

In some embodiments, the disclosure provides a CasX variant protein with improved stability relative to a reference CasX protein. In some embodiments, improved stability of the CasX variant protein results in expression of a higher steady state of protein, which improves editing efficiency. In some embodiments, improved stability of the CasX variant protein results in a larger fraction of CasX protein that remains folded in a functional conformation and improves editing efficiency or improves purifiability for manufacturing purposes. As used herein, a "functional conformation" refers to a CasX protein that is in a conformation where the protein is capable of binding a gNA and target DNA. In embodiments wherein the CasX variant does not carry one or more mutations rendering it catalytically dead, the CasX variant is capable of cleaving, nicking, or otherwise modifying the target DNA. For example, a functional CasX variant can, in some embodiments, be used for gene-editing, and a functional conformation refers to an "editing-competent" conformation. In some exemplary embodiments, including those embodiments where the CasX variant protein results in a larger fraction of CasX protein that remains folded in a functional conformation, a lower concentration of CasX variant is needed for applications such as gene editing compared to a reference CasX protein. Thus, in some embodiments, the CasX variant with improved stability has improved efficiency compared to a reference CasX in one or more gene editing contexts.

In some embodiments, the disclosure provides a CasX variant protein having improved thermostability relative to a reference CasX protein. In some embodiments, the CasX variant protein has improved thermostability of the CasX variant protein at a particular temperature range. Without wishing to be bound by any theory, some reference CasX proteins natively function in organisms with niches in groundwater and sediment; thus, some reference CasX proteins may have evolved to exhibit optimal function at lower or higher temperatures that may be desirable for certain applications. For example, one application of CasX variant proteins is gene editing of mammalian cells, which is typically carried out at about 37° C. In some embodiments, a CasX variant protein as described herein has improved thermostability compared to a reference CasX protein at a temperature of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability and functionality compared to a reference CasX protein that results in improved gene editing functionality, such as mammalian gene editing applications, which may include human gene editing applications.

In some embodiments, the disclosure provides a CasX variant protein having improved stability of the CasX variant protein:gNA complex relative to the reference CasX protein:gNA complex such that the RNP remains in a functional form. Stability improvements can include increased thermostability, resistance to proteolytic degradation, enhanced pharmacokinetic properties, stability across a range of pH conditions, salt conditions, and tonicity. Improved stability of the complex may, in some embodiments, lead to improved editing efficiency.

In some embodiments, the disclosure provides a CasX variant protein having improved thermostability of the CasX variant protein:gNA complex relative to the reference CasX protein:gNA complex. In some embodiments, a CasX variant protein has improved thermostability relative to a reference CasX protein. In some embodiments, the CasX variant protein:gNA complex has improved thermostability relative to a complex comprising a reference CasX protein at temperatures of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability of the CasX variant protein:gNA complex compared to a reference CasX protein:gNA complex, which results in improved function for gene editing applications, such as mammalian gene editing applications, which may include human gene editing applications.

In some embodiments, the improved stability and/or thermostability of the CasX variant protein comprises faster folding kinetics of the CasX variant protein relative to a reference CasX protein, slower unfolding kinetics of the CasX variant protein relative to a reference CasX protein, a larger free energy release upon folding of the CasX variant protein relative to a reference CasX protein, a higher temperature at which 50% of the CasX variant protein is unfolded (Tm) relative to a reference CasX protein, or any combination thereof. These characteristics may be improved by a wide range of values; for example, at least 1.1, at least 1.5, at least 10, at least 50, at least 100, at least 500, at least 1,000, at least 5,000, or at least a 10,000-fold improved, as compared to a reference CasX protein. In some embodiments, improved thermostability of the CasX variant protein comprises a higher Tm of the CasX variant protein relative to a reference CasX protein. In some embodiments, the Tm of the CasX variant protein is between about 20° C. to about 30° C., between about 30° C. to about 40° C., between about 40° C. to about 50° C., between about 50° C. to about 60° C., between about 60° C. to about 70° C., between about 70°

C. to about 80° C., between about 80° C. to about 90° C. or between about 90° C. to about 100° C. Thermal stability is determined by measuring the "melting temperature" (Tm), which is defined as the temperature at which half of the molecules are denatured. Methods of measuring characteristics of protein stability such as Tm and the free energy of unfolding are known to persons of ordinary skill in the art, and can be measured using standard biochemical techniques in vitro. For example, Tm may be measured using Differential Scanning calorimetry, a thermo-analytical technique in which the difference in the amount of heat required to increase the temperature of a sample and a reference is measured as a function of temperature (Chen et al (2003) Pharm Res 20:1952-60; Ghirlando et al (1999) Immunol Lett 68:47-52). Alternatively, or in addition, CasX variant protein Tm may be measured using commercially available methods such as the ThermoFisher Protein Thermal Shift system. Alternatively, or in addition, circular dichroism may be used to measure the kinetics of folding and unfolding, as well as the Tm (Murray et al. (2002) J. Chromatogr Sci 40:343-9). Circular dichroism (CD) relies on the unequal absorption of left-handed and right-handed circularly polarized light by asymmetric molecules such as proteins. Certain structures of proteins, for example alpha-helices and beta-sheets, have characteristic CD spectra. Accordingly, in some embodiments, CD may be used to determine the secondary structure of a CasX variant protein.

In some embodiments, improved stability and/or thermostability of the CasX variant protein comprises improved folding kinetics of the CasX variant protein relative to a reference CasX protein. In some embodiments, folding kinetics of the CasX variant protein are improved relative to a reference CasX protein by at least about 5, at least about 10, at least about 50, at least about 100, at least about 500, at least about 1,000, at least about 2,000, at least about 3,000, at least about 4,000, at least about 5,000, or at least about a 10,000-fold improvement. In some embodiments, folding kinetics of the CasX variant protein are improved relative to a reference CasX protein by at least about 1 kJ/mol, at least about 5 kJ/mol, at least about 10 kJ/mol, at least about 20 kJ/mol, at least about 30 kJ/mol, at least about 40 kJ/mol, at least about 50 kJ/mol, at least about 60 kJ/mol, at least about 70 kJ/mol, at least about 80 kJ/mol, at least about 90 kJ/mol, at least about 100 kJ/mol, at least about 150 kJ/mol, at least about 200 kJ/mol, at least about 250 kJ/mol, at least about 300 kJ/mol, at least about 350 kJ/mol, at least about 400 kJ/mol, at least about 450 kJ/mol, or at least about 500 kJ/mol.

Exemplary amino acid changes that can increase the stability of a CasX variant protein relative to a reference CasX protein may include, but are not limited to, amino acid changes that increase the number of hydrogen bonds within the CasX variant protein, increase the number of disulfide bridges within the CasX variant protein, increase the number of salt bridges within the CasX variant protein, strengthen interactions between parts of the CasX variant protein, increase the buried hydrophobic surface area of the CasX variant protein, or any combinations thereof.

k. Protein Yield

In some embodiments, the disclosure provides a CasX variant protein having improved yield during expression and purification relative to a reference CasX protein. In some embodiments, the yield of CasX variant proteins purified from bacterial or eukaryotic host cells is improved relative to a reference CasX protein. In some embodiments, the bacterial host cells are *Escherichia coli* cells. In some embodiments, the eukaryotic cells are yeast, plant (e.g. tobacco), insect (e.g. *Spodoptera frugiperda* sf9 cells), mouse, rat, hamster, guinea pig, monkey, or human cells. In some embodiments, the eukaryotic host cells are mammalian cells, including, but not limited to HEK293 cells, BHK cells, NS0 cells, SP2/0 cells, YO myeloma cells, P3X63 mouse myeloma cells, PER cells, PER.C6 cells, hybridoma cells, NIH3T3 cells, COS, HeLa, or CHO cells.

In some embodiments, improved yield of the CasX variant protein is achieved through codon optimization. Cells use 64 different codons, 61 of which encode the 20 standard amino acids, while another 3 function as stop codons. In some cases, a single amino acid is encoded by more than one codon. Different organisms exhibit bias towards use of different codons for the same naturally occurring amino acid. Therefore, the choice of codons in a protein, and matching codon choice to the organism in which the protein will be expressed, can, in some cases, significantly affect protein translation and therefore protein expression levels. In some embodiments, the CasX variant protein is encoded by a nucleic acid that has been codon optimized. In some embodiments, the nucleic acid encoding the CasX variant protein has been codon optimized for expression in a bacterial cell, a yeast cell, an insect cell, a plant cell, or a mammalian cell. In some embodiments, the mammal cell is a mouse, a rat, a hamster, a guinea pig, a monkey, or a human. In some embodiments, the CasX variant protein is encoded by a nucleic acid that has been codon optimized for expression in a human cell. In some embodiments, the CasX variant protein is encoded by a nucleic acid from which nucleotide sequences that reduce translation rates in prokaryotes and eukaryotes have been removed. For example, runs of greater than three thymine residues in a row can reduce translation rates in certain organisms or internal polyadenylation signals can reduce translation.

In some embodiments, improvements in solubility and stability, as described herein, result in improved yield of the CasX variant protein relative to a reference CasX protein.

Improved protein yield during expression and purification can be evaluated by methods known in the art. For example, the amount of CasX variant protein can be determined by running the protein on an SDS-page gel, and comparing the CasX variant protein to a either a control whose amount or concentration is known in advance to determine an absolute level of protein. Alternatively, or in addition, a purified CasX variant protein can be run on an SDS-page gel next to a reference CasX protein undergoing the same purification process to determine relative improvements in CasX variant protein yield. Alternatively, or in addition, levels of protein can be measured using immunohistochemical methods such as Western blot or ELISA with an antibody to CasX, or by HPLC. For proteins in solution, concentration can be determined by measuring of the protein's intrinsic UV absorbance, or by methods which use protein-dependent color changes such as the Lowry assay, the Smith copper/bicinchoninic assay or the Bradford dye assay. Such methods can be used to calculate the total protein (such as, for example, total soluble protein) yield obtained by expression under certain conditions. This can be compared, for example, to the protein yield of a reference CasX protein under similar expression conditions.

l. Protein Solubility

In some embodiments, a CasX variant protein has improved solubility relative to a reference CasX protein. In some embodiments, a CasX variant protein has improved solubility of the CasX:gNA ribonucleoprotein complex variant relative to a ribonucleoprotein complex comprising a reference CasX protein.

In some embodiments, an improvement in protein solubility leads to higher yield of protein from protein purification techniques such as purification from *E. coli*. Improved solubility of CasX variant proteins may, in some embodiments, enable more efficient activity in cells, as a more soluble protein may be less likely to aggregate in cells. Protein aggregates can in certain embodiments be toxic or burdensome on cells, and, without wishing to be bound by any theory, increased solubility of a CasX variant protein may ameliorate this result of protein aggregation. Further, improved solubility of CasX variant proteins may allow for enhanced formulations permitting the delivery of a higher effective dose of functional protein, for example in a desired gene editing application. In some embodiments, improved solubility of a CasX variant protein relative to a reference CasX protein results in improved yield of the CasX variant protein during purification of at least about 5, at least about 10, at least about 20, at least about 30, at least about 40, at least about 50, at least about 60, at least about 70, at least about 80, at least about 90, at least about 100, at least about 250, at least about 500, or at least about 1000-fold greater yield. In some embodiments, improved solubility of a CasX variant protein relative to a reference CasX protein improves activity of the CasX variant protein in cells by at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, or at least about 15-fold greater activity.

Methods of measuring CasX protein solubility, and improvements thereof in CasX variant proteins, will be readily apparent to the person of ordinary skill in the art. For example, CasX variant protein solubility can in some embodiments be measured by taking densitometry readings on a gel of the soluble fraction of lysed *E. coli*. Alternatively, or addition, improvements in CasX variant protein solubility can be measured by measuring the maintenance of soluble protein product through the course of a full protein purification. For example, soluble protein product can be measured at one or more steps of gel affinity purification, tag cleavage, cation exchange purification, running the protein on a size exclusion chromatography (SEC) column. In some embodiments, the densitometry of every band of protein on a gel is read after each step in the purification process. CasX variant proteins with improved solubility may, in some embodiments, maintain a higher concentration at one or more steps in the protein purification process when compared to the reference CasX protein, while an insoluble protein variant may be lost at one or more steps due to buffer exchanges, filtration steps, interactions with a purification column, and the like.

In some embodiments, improving the solubility of CasX variant proteins results in a higher yield in terms of mg/L of protein during protein purification when compared to a reference CasX protein.

In some embodiments, improving the solubility of CasX variant proteins enables a greater amount of editing events compared to a less soluble protein when assessed in editing assays such as the EGFP disruption assays described herein.

m. Protein Affinity for the gNA

In some embodiments, a CasX variant protein has improved affinity for the gNA relative to a reference CasX protein, leading to the formation of the ribonucleoprotein complex. Increased affinity of the CasX variant protein for the gNA may, for example, result in a lower $K_d$ for the generation of a RNP complex, which can, in some cases, result in a more stable ribonucleoprotein complex formation. In some embodiments, increased affinity of the CasX variant protein for the gNA results in increased stability of the ribonucleoprotein complex when delivered to human cells. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the ribonucleoprotein complex, allows for a lower dose of the CasX variant protein to be delivered to the subject or cells while still having the desired activity, for example in vivo or in vitro gene editing.

In some embodiments, a higher affinity (tighter binding) of a CasX variant protein to a gNA allows for a greater amount of editing events when both the CasX variant protein and the gNA remain in an RNP complex. Increased editing events can be assessed using editing assays such as the EGFP disruption assay described herein.

In some embodiments, the $K_d$ of a CasX variant protein for a gNA is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant has about 1.1 to about 10-fold increased binding affinity to the gNA compared to the reference CasX protein of SEQ ID NO: 2.

Without wishing to be bound by theory, in some embodiments amino acid changes in the Helical I domain can increase the binding affinity of the CasX variant protein with the gNA targeting sequence, while changes in the Helical II domain can increase the binding affinity of the CasX variant protein with the gNA scaffold stem loop, and changes in the oligonucleotide binding domain (OBD) increase the binding affinity of the CasX variant protein with the gRNA triplex.

Methods of measuring CasX protein binding affinity for a gNA include in vitro methods using purified CasX protein and gNA. The binding affinity for reference CasX and variant proteins can be measured by fluorescence polarization if the gNA or CasX protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference CasX and variant proteins of the disclosure for specific gNAs such as reference gNAs and variants thereof include, but are not limited to, isothermal calorimetry (ITC), and surface plasmon resonance (SPR), as well as the methods of the Examples.

n. Affinity for Target Nucleic Acid

In some embodiments, a CasX variant protein has improved binding affinity for a target nucleic acid relative to the affinity of a reference CasX protein for a target nucleic acid. In some embodiments, the improved affinity for the target nucleic acid comprises improved affinity for the target nucleic acid sequence, improved affinity for the PAM sequence, an improved ability to search DNA for the target nucleic acid sequence, or any combinations thereof. Without wishing to be bound by theory, it is thought that CRISPR/Cas system proteins such as CasX may find their target nucleic acid sequences by one-dimension diffusion along a DNA molecule. The process is thought to include (1) binding of the ribonucleoprotein to the DNA molecule followed by (2) stalling at the target nucleic acid sequence, either of which may be, in some embodiments, affected by improved affinity of CasX proteins for a target nucleic acid sequence, thereby improving function of the CasX variant protein compared to a reference CasX protein.

In some embodiments, a CasX variant protein with improved target nucleic acid affinity has increased overall affinity for DNA. In some embodiments, a CasX variant protein with improved target nucleic acid affinity has increased affinity for specific PAM sequences other than the canonical TTC PAM recognized by the reference CasX protein of SEQ ID NO: 2, including binding affinity for PAM sequences selected from the group consisting of TTC, ATC, GTC, and CTC. Without wishing to be bound by theory, it is possible that these protein variants will interact more strongly with DNA overall and will have an increased ability to access and edit sequences within the target DNA due to the ability to bind additional PAM sequences beyond those of wild-type Cas X, thereby allowing for a more efficient search process of the CasX protein for the target sequence. A higher overall affinity for DNA also, in some embodiments, can increase the frequency at which a CasX protein can effectively start and finish a binding and unwinding step, thereby facilitating target strand invasion and R-loop formation, and ultimately the cleavage of a target nucleic acid sequence.

Without wishing to be bound by theory, it is possible that amino acid changes in the NTSBD that increase the efficiency of unwinding, or capture, of a non-target DNA strand in the unwound state, can increase the affinity of CasX variant proteins for target DNA. Alternatively, or in addition, amino acid changes in the NTSBD that increase the ability of the NTSBD to stabilize DNA during unwinding can increase the affinity of CasX variant proteins for target DNA. Alternatively, or in addition, amino acid changes in the OBD may increase the affinity of CasX variant protein binding to the protospacer adjacent motif (PAM), thereby increasing affinity of the CasX variant protein for target nucleic acid. Alternatively, or in addition, amino acid changes in the Helical I and/or II, RuvC and TSL domains that increase the affinity of the CasX variant protein for the target nucleic acid strand can increase the affinity of the CasX variant protein for target nucleic acid.

In some embodiments, the CasX variant protein has increased binding affinity to the target nucleic acid sequence compared to the reference protein of SEQ ID NO: 1, SEQ ID NO: 2, or SEQ ID NO: 3. In some embodiments, affinity of a CasX variant protein of the disclosure for a target nucleic acid molecule is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100.

In some embodiments, a CasX variant protein has improved binding affinity for the non-target strand of the target nucleic acid. As used herein, the term "non-target strand" refers to the strand of the DNA target nucleic acid sequence that does not form Watson and Crick base pairs with the targeting sequence in the gNA, and is complementary to the target strand.

Methods of measuring CasX protein (such as reference or variant) affinity for a target nucleic acid molecule may include electrophoretic mobility shift assays (EMSAs), filter binding, isothermal calorimetry (ITC), and surface plasmon resonance (SPR), fluorescence polarization and biolayer interferometry (BLI). Further methods of measuring CasX protein affinity for a target include in vitro biochemical assays that measure DNA cleavage events over time.

CasX variant proteins with higher affinity for their target nucleic acid may, in some embodiments, cleave the target nucleic acid sequence more rapidly than a reference CasX protein that does not have increased affinity for the target nucleic acid.

In some embodiments, the CasX variant protein is catalytically dead (dCasX). In some embodiments, the disclosure provides RNP comprising a catalytically-dead CasX protein that retains the ability to bind target DNA. An exemplary catalytically-dead CasX variant protein comprises one or more mutations in the active site of the RuvC domain of the CasX protein. In some embodiments, a catalytically-dead CasX variant protein comprises substitutions at residues 672, 769 and/or 935 of SEQ ID NO: 1. In some embodiments, a catalytically-dead CasX variant protein comprises substitutions of D672A, E769A and/or D935A in the reference CasX protein of SEQ ID NO: 1. In some embodiments, a catalytically-dead CasX protein comprises substitutions at amino acids 659, 765 and/or 922 of SEQ ID NO: 2. In some embodiments, a catalytically-dead CasX protein comprises D659A, E756A and/or D922A substitutions in a reference CasX protein of SEQ ID NO: 2. In further embodiments, a catalytically-dead CasX variant protein comprises deletions of all or part of the RuvC domain of the reference CasX protein.

In some embodiments, improved affinity for DNA of a CasX variant protein also improves the function of catalytically inactive versions of the CasX variant protein. In some embodiments, the catalytically inactive version of the CasX variant protein comprises one or mutations in the DED motif in the RuvC. Catalytically dead CasX variant proteins can, in some embodiments, be used for base editing or epigenetic modifications. With a higher affinity for DNA, in some embodiments, catalytically dead CasX variant proteins can, relative to catalytically active CasX, find their target DNA faster, remain bound to target DNA for longer periods of time, bind target DNA in a more stable fashion, or a combination thereof, thereby improving the function of the catalytically dead CasX variant protein.

o. Improved Specificity for a Target Site

In some embodiments, a CasX variant protein has improved specificity for a target nucleic acid sequence relative to a reference CasX protein. As used herein, "specificity," sometimes referred to as "target specificity," refers to the degree to which a CRISPR/Cas system ribonucleoprotein complex cleaves off-target sequences that are similar, but not identical to the target nucleic acid sequence; e.g., a CasX variant RNP with a higher degree of specificity would exhibit reduced off-target cleavage of sequences relative to a reference CasX protein. The specificity, and the reduction of potentially deleterious off-target effects, of CRISPR/Cas system proteins can be vitally important in order to achieve an acceptable therapeutic index for use in mammalian subjects.

In some embodiments, a CasX variant protein has improved specificity for a target site within the target nucleic acid sequence that is complementary to the targeting sequence of the gNA.

Without wishing to be bound by theory, it is possible that amino acid changes in the Helical I and II domains that increase the specificity of the CasX variant protein for the target nucleic acid strand can increase the specificity of the CasX variant protein for the target nucleic acid overall. In some embodiments, amino acid changes that increase specificity of CasX variant proteins for target nucleic acid may also result in decreased affinity of CasX variant proteins for DNA.

Methods of testing CasX protein (such as variant or reference) target specificity may include guide and Circularization for In vitro Reporting of Cleavage Effects by Sequencing (CIRCLE-seq), or similar methods. In brief, in CIRCLE-seq techniques, genomic DNA is sheared and circularized by ligation of stem-loop adapters, which are nicked in the stem-loop regions to expose 4 nucleotide palindromic overhangs. This is followed by intramolecular ligation and degradation of remaining linear DNA. Circular DNA molecules containing a CasX cleavage site are subsequently linearized with CasX, and adapter adapters are ligated to the exposed ends followed by high-throughput sequencing to generate paired end reads that contain information about the off-target site. Additional assays that can be used to detect off-target events, and therefore CasX protein specificity include assays used to detect and quantify indels (insertions and deletions) formed at those selected off-target sites such as mismatch-detection nuclease assays and next generation sequencing (NGS). Exemplary mismatch-detection assays include nuclease assays, in which genomic DNA from cells treated with CasX and sgRNA is PCR amplified, denatured and rehybridized to form hetero-duplex DNA, containing one wild type strand and one strand with an indel. Mismatches are recognized and cleaved by mismatch detection nucleases, such as Surveyor nuclease or T7 endonuclease I.

p. Unwinding of DNA

In some embodiments, a CasX variant protein has improved ability of unwinding DNA relative to a reference CasX protein. Poor dsDNA unwinding has been shown previously to impair or prevent the ability of CRISPR/Cas system proteins AnaCas9 or Cas14s to cleave DNA. Therefore, without wishing to be bound by any theory, it is likely that increased DNA cleavage activity by some CasX variant proteins of the disclosure is due, at least in part, to an increased ability to find and unwind the dsDNA at a target site.

Without wishing to be bound by theory, it is thought that amino acid changes in the NTSB domain may produce CasX variant proteins with increased DNA unwinding characteristics. Alternatively, or in addition, amino acid changes in the OBD or the helical domain regions that interact with the PAM may also produce CasX variant proteins with increased DNA unwinding characteristics.

Methods of measuring the ability of CasX proteins (such as variant or reference) to unwind DNA include, but are not limited to, in vitro assays that observe increased on rates of dsDNA targets in fluorescence polarization or biolayer interferometry.

q. Catalytic Activity

The ribonucleoprotein complex of the CasX:gNA systems disclosed herein comprise a reference CasX protein or variant thereof that bind to a target nucleic acid and cleaves the target nucleic acid. In some embodiments, a CasX variant protein has improved catalytic activity relative to a reference CasX protein. Without wishing to be bound by theory, it is thought that in some cases cleavage of the target strand can be a limiting factor for Cas12-like molecules in creating a dsDNA break. In some embodiments, CasX variant proteins improve bending of the target strand of DNA and cleavage of this strand, resulting in an improvement in the overall efficiency of dsDNA cleavage by the CasX ribonucleoprotein complex.

In some embodiments, a CasX variant protein has increased nuclease activity compared to a reference CasX protein. Variants with increased nuclease activity can be generated, for example, through amino acid changes in the RuvC nuclease domain. In some embodiments, the CasX variant comprises a nuclease domain having nickase activity. In the foregoing, the CasX nickase of a CasX:gNA system generates a single-stranded break within 10-18 nucleotides 3' of a PAM site in the non-target strand. In other embodiments, the CasX variant comprises a nuclease domain having double-stranded cleavage activity. In the foregoing, the CasX of the CasX:gNA system generates a double-stranded break within 18-26 nucleotides 5' of a PAM site on the target strand and 10-18 nucleotides 3' on the non-target strand. Nuclease activity can be assayed by a variety of methods, including those of the Examples. In some embodiments, a CasX variant has a $K_{cleave}$ constant that is at least 2-fold, or at least 3-fold, or at least 4-fold, or at least 5-fold, or at least 6-fold, or at least 7-fold, or at least 8-fold, or at least 9-fold, or at least 10-fold greater compared to a reference CasX.

In some embodiments, a CasX variant protein has the improved characteristic of forming RNP with gNA that result in a higher percentage of cleavage-competent RNP compared to an RNP of a reference CasX protein of SEQ ID NO: 1, SEQ ID NO: 2, or SEQ ID NO: 3 and the gNA, as described in the Examples. By cleavage competent, it is meant that the RNP that is formed has the ability to cleave the target nucleic acid. In some embodiments, the RNP of the CasX variant and the gNA exhibit at least a 2% to at least 30%, or at least a 5% to at least a 20%, or at least a 10% to at least a 15% higher percentage of cleavage-competent RNP compared to an RNP of the reference CasX of SEQ ID NO: 1, SEQ ID NO: 2, or SEQ ID NO: 3 and the gNA of Table 2A.

In some embodiments, a CasX variant protein has increased target strand loading for double strand cleavage compared to a reference CasX. Variants with increased target strand loading activity can be generated, for example, through amino acid changes in the TLS domain.

Without wishing to be bound by theory, amino acid changes in the TSL domain may result in CasX variant proteins with improved catalytic activity. Alternatively, or in addition, amino acid changes around the binding channel for the RNA:DNA duplex may also improve catalytic activity of the CasX variant protein.

In some embodiments, a CasX variant protein has increased collateral cleavage activity compared to a reference CasX protein. As used herein, "collateral cleavage activity" refers to additional, non-targeted cleavage of nucleic acids following recognition and cleavage of a target nucleic acid. In some embodiments, a CasX variant protein has decreased collateral cleavage activity compared to a reference CasX protein.

In some embodiments, for example those embodiments encompassing applications where cleavage of the target nucleic acid is not a desired outcome, improving the catalytic activity of a CasX variant protein comprises altering, reducing, or abolishing the catalytic activity of the CasX variant protein. In some embodiments, a ribonucleoprotein complex comprising a dCasX variant protein binds to a target nucleic acid and does not cleave the target nucleic acid.

In some embodiments, the CasX ribonucleoprotein complex comprising a CasX variant protein binds a target DNA but generates a single stranded nick in the target DNA. In some embodiments, particularly those embodiments wherein the CasX protein is a nickase, a CasX variant protein has decreased target strand loading for single strand nicking. Variants with decreased target strand loading may be generated, for example, through amino acid changes in the TSL domain.

Exemplary methods for characterizing the catalytic activity of CasX proteins may include, but are not limited to, in vitro cleavage assays, including those of the Examples, below. In some embodiments, electrophoresis of DNA products on agarose gels can interrogate the kinetics of strand cleavage.

r. Affinity for SOD1 Target RNA

In some embodiments, a ribonucleoprotein complex comprising a reference CasX protein or variant thereof binds to a target SOD1 RNA and cleaves the target nucleic acid. In some embodiments, variants of a reference CasX protein increase the specificity of the CasX variant protein for a target SOD1 RNA, and increase the activity of the CasX variant protein with respect to a target RNA when compared to the reference CasX protein. For example, CasX variant proteins can display increased binding affinity for target RNAs, or increased cleavage of target RNAs, when compared to reference CasX proteins. In some embodiments, a ribonucleoprotein complex comprising a CasX variant protein binds to a target RNA and/or cleaves the target RNA. In some embodiments, a CasX variant has at least about two-fold to about 10-fold increased binding affinity to the SOD1 target nucleic acid compared to the reference protein of SEQ ID NO: 1, SEQ ID NO: 2, or SEQ ID NO: 3.

s. Combinations of Mutations

The present disclosure provides Cas X variants that are a combination of mutations from separate CasX variant proteins. In some embodiments, any variant to any domain described herein can be combined with other variants described herein. In some embodiments, any variant within any domain described herein can be combined with other variants described herein, in the same domain. Combinations of different amino acid changes may in some embodiments produce new optimized variants whose function is further improved by the combination of amino acid changes. In some embodiments, the effect of combining amino acid changes on CasX protein function is linear. As used herein, a combination that is linear refers to a combination whose effect on function is equal to the sum of the effects of each individual amino acid change when assayed in isolation. In some embodiments, the effect of combining amino acid changes on CasX protein function is synergistic. As used herein, a combination of variants that is synergistic refers to a combination whose effect on function is greater than the sum of the effects of each individual amino acid change when assayed in isolation. In some embodiments, combining amino acid changes produces CasX variant proteins in which more than one function of the CasX protein has been improved relative to the reference CasX protein.

t. CasX Fusion Proteins

In some embodiments, the disclosure provides CasX proteins comprising a heterologous protein fused to the CasX. In some cases, the CasX is a reference CasX protein. In other cases, the CasX is a CasX variant of any of the embodiments described herein.

In some embodiments, the CasX variant protein is fused to one or more proteins or domains thereof that has a different activity of interest, resulting in a fusion protein. For example, in some embodiments, the CasX variant protein is fused to a protein (or domain thereof) that inhibits transcription, modifies a target nucleic acid, or modifies a polypeptide associated with a nucleic acid (e.g., histone modification).

In some embodiments, a heterologous polypeptide (or heterologous amino acid such as a cysteine residue or a non-natural amino acid) can be inserted at one or more positions within a CasX protein to generate a CasX fusion protein. In other embodiments, a cysteine residue can be inserted at one or more positions within a CasX protein followed by conjugation of a heterologous polypeptide described below. In some alternative embodiments, a heterologous polypeptide or heterologous amino acid can be added at the N- or C-terminus of the reference or CasX variant protein. In other embodiments, a heterologous polypeptide or heterologous amino acid can be inserted internally within the sequence of the CasX protein.

In some embodiments, the reference CasX or variant fusion protein retains RNA-guided sequence specific target nucleic acid binding and cleavage activity. In some cases, the reference CasX or variant fusion protein has (retains) 50% or more of the activity (e.g., cleavage and/or binding activity) of the corresponding reference CasX or variant protein that does not have the insertion of the heterologous protein. In some cases, the reference CasX or variant fusion protein retains at least about 60%, or at least about 70% or more, at least about 80%, or at least about 90%, or at least about 92%, or at least about 95%, or at least about 98%, or at least about 100% of the activity (e.g., cleavage and/or binding activity) of the corresponding CasX protein that does not have the insertion of the heterologous protein.

In some cases, the reference CasX or variant fusion protein retains (has) target nucleic acid binding activity relative to the activity of the CasX protein without the inserted heterologous amino acid or heterologous polypeptide. In some cases, the reference CasX or variant fusion protein retains at least about 60%, or at least about 70% or more, at least about 80%, or at least about 90%, or at least about 92%, or at least about 95%, or at least about 98%, or at least about 100% of the binding activity of the corresponding CasX protein that does not have the insertion of the heterologous protein.

In some cases, the reference CasX or variant fusion protein retains (has) target nucleic acid binding and/or cleavage activity relative to the activity of the parent CasX protein without the inserted heterologous amino acid or heterologous polypeptide. For example, in some cases, the reference CasX or variant fusion protein has (retains) 50% or more of the binding and/or cleavage activity of the corresponding parent CasX protein (the CasX protein that does not have the insertion). For example, in some cases, the reference CasX or variant fusion protein has (retains) 60% or more (70% or more, 80% or more, 90% or more, 92% or more, 95% or more, 98% or more, or 100%) of the binding and/or cleavage activity of the corresponding CasX parent protein (the CasX protein that does not have the insertion). Methods of measuring cleaving and/or binding activity of a CasX protein and/or a CasX fusion protein will be known to one of ordinary skill in the art and any convenient method can be used.

A variety of heterologous polypeptides are suitable for inclusion in a reference CasX or CasX variant fusion protein of the disclosure. In some cases, the fusion partner can modulate transcription (e.g., inhibit transcription, increase transcription) of a target DNA. For example, in some cases the fusion partner is a protein (or a domain from a protein) that inhibits transcription (e.g., a transcriptional repressor, a protein that functions via recruitment of transcription inhibitor proteins, modification of target DNA such as methylation, recruitment of a DNA modifier, modulation of histones associated with target DNA, recruitment of a histone modifier such as those that modify acetylation and/or methylation of histones, and the like). In some cases the fusion partner is a protein (or a domain from a protein) that increases transcription (e.g., a transcription activator, a protein that acts via recruitment of transcription activator proteins, modification of target DNA such as demethylation, recruitment of a DNA modifier, modulation of histones associated with target DNA, recruitment of a histone modifier such as those that modify acetylation and/or methylation of histones, and the like).

In some cases, a fusion partner has enzymatic activity that modifies a target nucleic acid; e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity.

In some cases, a fusion partner has enzymatic activity that modifies a polypeptide (e.g., a histone) associated with a target nucleic acid (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

Examples of proteins (or fragments thereof) that can be used as a fusion partner to increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET domain containing 1A, histone lysine methyltransferase (SET1A), SET domain containing 1B, histone lysine methyltransferase (SET1B), lysine methyltransferase (MLL1 to 5), ASCL1 (ASH1) achaete-scute family bHLH transcription factor 1 (ASH1), SET and MYND domain containing 2 (SYMD2), nuclear receptor binding SET domain protein 1 (NSD1), and the like; histone lysine demethylases such as lysine demethylase 3A (JHDM2a)/Lysine-specific demethylase 3B (JHDM2b), lysine demethylase 6A (UTX), lysine demethylase 6B (JMJD3), and the like; histone acetyltransferases such as lysine acetyltransferase 2A (GCN5), lysine acetyltransferase 2B (PCAF), CREB binding protein (CBP), E1A binding protein p300 (p300), TATA-box binding protein associated factor 1 (TAF1), lysine acetyltransferase 5 (TIP60/PLIP), lysine acetyltransferase 6A (MOZ/MYST3), lysine acetyltransferase 6B (MORF/MYST4), SRC proto-oncogene, non-receptor tyrosine kinase (SRC1), nuclear receptor coactivator 3 (ACTR), MYB binding protein 1a (P160), clock circadian regulator (CLOCK), and the like; and DNA demethylases such as Ten-Eleven Translocation (TET) dioxygenase 1 (TET1CD), tet methylcytosine dioxygenase 1 (TET1), demeter (DME), demeter-like 1 (DML1), demeter-like 2 (DML2), protein ROS1 (ROS1), and the like.

Examples of proteins (or fragments thereof) that can be used as a fusion partner to decrease transcription include but are not limited to: transcriptional repressors such as the Kruppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as PR/SET domain containing protein (Pr-SET7/8), lysine methyltransferase 5B (SUV4-20H1), PR/SET domain 2 (RIZ1), and the like; histone lysine demethylases such as lysine demethylase 4A (JMJD2A/JHDM3A), lysine demethylase 4B (JMJD2B), lysine demethylase 4C (JMJD2C/GASC1), lysine demethylase 4D (JMJD2D), lysine demethylase 5A (JARID1A/RBP2), lysine demethylase 5B (JARID1B/PLU-1), lysine demethylase 5C (JARID 1C/SMCX), lysine demethylase 5D (JARID1D/SMCY), and the like; histone lysine deacetylases such as histone deacetylase 1 (HDAC1), HDAC2, HDAC3, HDAC8, HDAC4, HDAC5, HDAC7, HDAC9, sirtuin 1 (SIRT1), SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), methyltransferase 1 (MET1), S-adenosyl-L-methionine-dependent methyltransferases superfamily protein (DRM3) (plants), DNA cytosine methyltransferase MET2a (ZMET2), chromomethylase 1 (CMT1), chromomethylase 2 (CMT2) (plants), and the like; and periphery recruitment elements such as Lamin A, Lamin B, and the like.

In some cases, the fusion partner has enzymatic activity that modifies the target nucleic acid (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), MET1, DRM3 (plants), ZMET2, CMT1, CMT2 (plants), and the like); demethylase activity such as that provided by a demethylase (e.g., Ten-Eleven Translocation (TET) dioxygenase 1 (TET 1 CD), TET1, DME, DML1, DML2, ROS1, and the like), DNA repair activity, DNA damage activity, deamination activity such as that provided by a deaminase (e.g., a cytosine deaminase enzyme, e.g., an APOBEC protein such as rat apolipoprotein B mRNA editing enzyme, catalytic polypeptide 1 {APOBEC1}), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases, a reference CasX or CasX variant protein of the present disclosure is fused to a polypeptide selected from a domain for increasing transcription (e.g., a VP16 domain, a VP64 domain), a domain for decreasing transcription (e.g., a KRAB domain, e.g., from the Kox1 protein), a core catalytic domain of a histone acetyltransferase (e.g., histone acetyltransferase p300), a protein/domain that provides a detectable signal (e.g., a fluorescent protein such as GFP), a nuclease domain (e.g., a FokI nuclease), or a base editor (e.g., cytidine deaminase such as APOBEC1).

In some cases, the fusion partner has enzymatic activity that modifies a protein associated with the target nucleic acid (e.g., ssRNA, dsRNA, ssDNA, dsDNA) (e.g., a histone, an RNA binding protein, a DNA binding protein, and the like). Examples of enzymatic activity (that modifies a protein associated with a target nucleic acid) that can be provided by the fusion partner include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB 1, and the like, SET1A, SET1B, MLL1 to 5, ASH1, SYMD2, NSD1, DOT1L, Pr-SET7/8, SUV4-20H1, EZH2, RIZ1), demethylase activity such as that provided by a histone demethylase (e.g., Lysine Demethylase 1A (KDM1A also known as LSD1), JHDM2a/b, JMJD2A/ JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/ PLIP, MOZ/MYST3, MORF/MYST4, HB01/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

Additional examples of suitable fusion partners are (i) a dihydrofolate reductase (DHFR) destabilization domain (e.g., to generate a chemically controllable subject RNA-guided polypeptide or a conditionally active RNA-guided polypeptide), and (ii) a chloroplast transit peptide.

Suitable chloroplast transit peptides include, but are not limited to:

(SEQ ID NO: 132)
MASMISSSAVTTVSRASRGQSAAMAPFGGLKSMTGFPVRKVNTDITSITSN

GGRVKCMQVWPPIGKKKFETLSYLPPLTRDSRA;

(SEQ ID NO: 133)
MASMISSSAVTTVSRASRGQSAAMAPFGGLKSMTGFPVRKVNTDITSITSN

GGRVKS;

(SEQ ID NO: 134)
MASSMLSSATMVASPAQATMVAPFNGLKSSAAFPATRKANNDITSITSNGG

RVNCMQV WPPIEKKKFETLSYLPDLTDSGGRVNC;

(SEQ ID NO: 135)
MAQVSRICNGVQNPSLISNLSKSSQRKSPLSVSLKTQQHPRAYPISSSWGL

KKSGMTLIG SELRPLKVMSSVSTAC;

(SEQ ID NO: 136)
MAQVSRICNGVWNPSLISNLSKSSQRKSPLSVSLKTQQHPRAYPISSSWGL

KKSGMTLIG SELRPLKVMSSVSTAC;

(SEQ ID NO: 137)
MAQINNMAQGIQTLNPNSNFHKPQVPKSSSFLVFGSKKLKNSANSMLVLKK

DSIFMQLF CSFRISASVATAC;

(SEQ ID NO: 138)
MAALVTSQLATSGTVLSVTDRFRRPGFQGLRPRNPADAALGMRTVGASAAP

KQSRKP HRFDRRCLSMVV;

(SEQ ID NO: 139)
MAALTTSQLATSATGFGIADRSAPSSLLRHGFQGLKPRSPAGGDATSLSVT

TSARATPKQ QRSVQRGSRRFPSVVVC;

(SEQ ID NO: 12496)
MASSVLSSAAVATRSNVAQANMVAPFTGLKSAASFPVSRKQNLDITSIASN

GGRVQC;

(SEQ ID NO: 140)
MESLAATSVFAPSRVAVPAARALVRAGTVVPTRRTSSTSGTSGVKCSAAVT

PQASPVIS RSAAAA;
and (SEQ ID NO: 141)
MGAAATSMQSLKFSNRLVPPSRRLSPVPNNVTCNNLPKSAAPVRTVKCCAS

SWNSTINGAAATTNGASAASS.

In some cases, a reference CasX or variant protein of the present disclosure can include an endosomal escape peptide. In some cases, an endosomal escape polypeptide comprises the amino acid sequence GLFXALLXLLXSLWXLLLXA (SEQ ID NO: 142), wherein each X is independently selected from lysine, histidine, and arginine. In some cases, an endosomal escape polypeptide comprises the amino acid sequence GLFHALLHLLHSLWHLLLHA (SEQ ID NO: 143), or HHHHHHHHH (SEQ ID NO: 144).

Non-limiting examples of fusion partners for use when targeting ssRNA target nucleic acids include (but are not limited to): splicing factors (e.g., RS domains); protein translation components (e.g., translation initiation, elongation, and/or release factors; e.g., eIF4G); RNA methylases; RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or, in some cases, can include a fragment of the protein (e.g., a functional domain).

A fusion partner for a reference CasX or CasX variant can be any domain capable of interacting with ssRNA (which, for the purposes of this disclosure, includes intramolecular and/or intermolecular secondary structures, e.g., double-stranded RNA duplexes such as hairpins, stem-loops, etc.), whether transiently or irreversibly, directly or indirectly, including but not limited to an effector domain selected from the group comprising; endonucleases (for example RNase III, the CRR22 DYW domain, Dicer, and PIN (PilT N-terminus) domains from proteins such as SMG5 and SMG6); proteins and protein domains responsible for stimulating RNA cleavage (for example cleavage and polyadenylation specific factor {CPSF}, cleavage stimulation factor {CstF}, CFIm and CFIIm); exonucleases (for example chromatin-binding exonuclease XRN1 (XRN-1) or Exonuclease T); deadenylases (for example DNA 5'-adenosine monophosphate hydrolase {HNT3}); proteins and protein domains responsible for nonsense mediated RNA decay (for example UPF1 RNA helicase and ATPase {UPF1}, UPF2, UPF3, UPF3b, RNP SI, RNA binding motif protein 8A {Y14}, DEK proto-oncogene {DEK}, RNA-processing protein REF2 {REF2}, and Serine-arginine repetitive matrix 1 {SRm160}); proteins and protein domains responsible for stabilizing RNA (for example poly(A) binding protein cytoplasmic 1 {PABP}); proteins and protein domains responsible for repressing translation (for example argonaute RISC catalytic component 2 {Ago2} and Ago4); proteins and protein domains responsible for stimulating translation (for example Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example poly (A) polymerase (PAP1), PAP-associated domain-containing protein;Poly(A) RNA polymerase gld-2 {GLD-2}, and Star-PAP); proteins and protein domains responsible for polyuridinylation of RNA (for example Terminal uridylyltransferase {CID1} and terminal uridylate transferase); proteins and protein domains responsible for RNA localization (for example from insulin like growth factor 2 mRNA binding protein 1 {IMP1}, Z-DNA binding protein 1 {ZBP1}, She2p, She3p, and Bicaudal-D); proteins and protein domains responsible for nuclear retention of RNA (for example Rrp6); proteins and protein domains responsible for nuclear export of RNA (for example nuclear RNA export factor 1 {TAP}, nuclear RNA export factor 1 {NXF1}, THO Complex {THO}, TREX, REF, and Aly/REF export factor {Aly}); proteins and protein domains responsible for repression of RNA splicing (for example polypyrimidine tract binding protein 1 {PTB}, KH RNA binding domain containing, signal transduction associated 1 Sam68}, and heterogeneous nuclear ribonucleoprotein A1 {hnRNP A1}); proteins and protein domains responsible for stimulation of RNA splicing (for example serine/arginine-rich (SR) domains); proteins and protein domains responsible for reducing the efficiency of transcription (for example FUS RNA binding protein {FUS (TLS)}); and proteins and protein domains responsible for stimulating transcription (for example cyclin dependent kinase 7 {CDK7} and HIV Tat). Alternatively, the effector domain may be selected from the group comprising endonucleases; proteins and protein domains capable of stimulating RNA cleavage; exonucleases; deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable heterologous polypeptide is a PUF RNA-binding domain, which is described in more detail in WO2012068627, which is hereby incorporated by reference in its entirety.

Some RNA splicing factors that can be used (in whole or as fragments thereof) as a fusion partner have modular organization, with separate sequence-specific RNA binding modules and splicing effector domains. For example, members of the serine/arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal glycine-rich domain. Some splicing factors can regulate alternative use of splice site (ss) by binding to regulatory sequences between the two alternative sites. For example, ASF/SF2 can recognize ESEs and promote the use of intron proximal sites, whereas hnRNP A1 can bind to ESSs and shift splicing towards the use of intron distal sites. One application for such factors is to generate ESFs that modulate alternative splicing of endogenous genes, particularly disease associated genes. For example, BCL2 like 1 (Bcl-x) pre-mRNA produces two splicing isoforms with two alternative 5' splice sites to encode proteins of opposite functions. The long splicing isoform Bcl-xL is a potent apoptosis inhibitor expressed in long-lived post mitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cc-elements that are located in either the core exon region or the exon extension region (i.e., between the two alternative 5' splice sites). For more examples, see WO2010075303, which is hereby incorporated by reference in its entirety.

Further suitable fusion partners include, but are not limited to proteins (or fragments thereof) that are boundary elements (e.g., CTCF), proteins and fragments thereof that provide periphery recruitment (e.g., Lamin A, Lamin B, etc.), and protein docking elements (e.g., FKBP/FRB, Pill/Abyl, etc.).

In some cases, a heterologous polypeptide (a fusion partner) provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a subject RNA-guided polypeptide or a conditionally active RNA-guided polypeptide and/or subject CasX fusion protein does not include a NLS so that the protein is not targeted to the nucleus (which can be advantageous, e.g., when the target nucleic acid is an RNA that is present in the cytosol). In some embodiments, a fusion partner can provide a tag (i.e., the heterologous polypeptide is a detectable label) for ease of tracking and/or purification (e.g., a fluorescent protein, e.g., green fluorescent protein (GFP), yellow fluorescent protein (YFP), red fluorescent protein (RFP), cyan fluorescent protein (CFP), mCherry, tdTomato, and the like; a histidine tag, e.g., a 6XHis tag; a hemagglutinin (HA) tag; a FLAG tag; a Myc tag; and the like).

In some cases, a reference or CasX variant protein includes (is fused to) a nuclear localization signal (NLS). In some cases, a reference or CasX variant protein is fused to 2 or more, 3 or more, 4 or more, or 5 or more 6 or more, 7 or more, 8 or more NLSs. In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (2 or more, 3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus. In some cases, a reference or CasX variant protein includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases, a reference or CasX variant protein includes (is fused to) between 2 and 5 NLSs (e.g., 2-4, or 2-3 NLSs).

Non-limiting examples of NLSs include sequences derived from: the NLS of the SV40 virus large T-antigen, having the amino acid sequence PKKKRKV (SEQ ID NO: 145); the NLS from nucleoplasmin (e.g., the nucleoplasmin bipartite NLS with the sequence KRPAATKKAGQAKKKK (SEQ ID NO: 146); the c-myc NLS having the amino acid sequence PAAKRVKLD (SEQ ID NO: 147) or RQRR-NELKRSP (SEQ ID NO: 148); the hRNPA1 M9 NLS having the sequence NQSSNFGPMKGGNFG-GRSSGPYGGGGQYFAKPRNQGGY (SEQ ID NO: 149); the sequence RMRIZFKNKGKDTAELRRRRVEVS-VELRKAKKDEQILKRRNV (SEQ ID NO: 150) of the IBB domain from importin-alpha; the sequences VSRKRPRP (SEQ ID NO: 151) and PPKKARED (SEQ ID NO: 152) of the myoma T protein; the sequence PQPKKKPL (SEQ ID NO: 153) of human p53; the sequence SALI AP (SEQ ID NO: 154) of mouse c-abl IV; the sequences DRLRR (SEQ ID NO: 155) and PKQKKRK (SEQ ID NO: 156) of the influenza virus NS1; the sequence RKLKKKIKKL (SEQ ID NO: 157) of the Hepatitis virus delta antigen; the sequence REKKKFLKRR (SEQ ID NO: 158) of the mouse Mx1 protein; the sequence KRKGDEVDGVDEVAKKKSKK (SEQ ID NO: 159) of the human poly(ADP-ribose) polymerase; the sequence RKCLQAGMNLEARKTKK (SEQ ID NO: 160) of the steroid hormone receptors (human) glucocorticoid; the sequence PRPRKIPR (SEQ ID NO: 161) of Borna disease virus P protein (BDV-P1); the sequence PPRKKRTVV (SEQ ID NO: 162) of hepatitis C virus nonstructural protein (HCV-NS5A); the sequence NLSKKKKRKREK (SEQ ID NO: 163) of LEF1; the sequence RRPSRPFRKP (SEQ ID NO: 164) of ORF57 simirae; the sequence KRPRSPSS (SEQ ID NO: 165) of EBV LANA; the sequence KRGINDRNFWRGENERKTR (SEQ ID NO: 166) of Influenza A protein; the sequence PRPPKMARYDN (SEQ ID NO: 167) of human RNA helicase A (RHA); the sequence KRSFSKAF (SEQ ID NO: 168) of nucleolar RNA helicase II; the sequence KLKIKRPVK (SEQ ID NO: 169) of TUS-protein; the sequence PKKKRKVPPPPAAKRVKLD (SEQ ID NO: 170) associated with importin-alpha; the sequence PKTRRR-PRRSQRKRPPT (SEQ ID NO: 171) from the Rex protein in HTLV-1; the sequence MSRRR-KANPTKLSENAKKLAKEVEN (SEQ ID NO: 172) from the EGL-13 protein of Caenorhabditis elegans; and the sequences KTRRRPRRSQRKRPPT (SEQ ID NO: 173), RRKKRRPRRKKRR (SEQ ID NO: 174), PKKKSRKPKKKSRK (SEQ ID NO: 175), HKKKHP-DASVNFSEFSK (SEQ ID NO: 176), QRPGPY-DRPQRPGPYDRP (SEQ ID NO: 177), LSPSLSPLLSPSL-SPL (SEQ ID NO: 178), RGKGGKGLGKGGAKRHRK (SEQ ID NO: 179), PKRGRGRPKRGRGR (SEQ ID NO: 180), PKKKRKVPPPPAAKRVKLD (SEQ ID NO: 181) and PKKKRKVPPPPKKKRKV (SEQ ID NO: 182). In general, NLS (or multiple NLSs) are of sufficient strength to drive accumulation of a reference or CasX variant fusion protein in the nucleus of a eukaryotic cell. Detection of accumulation in the nucleus may be performed by any suitable technique. For example, a detectable marker may be fused to a reference or CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined.

In some cases, a reference or CasX variant fusion protein includes a "Protein Transduction Domain" or PTD (also known as a CP—cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a reference or CasX variant fusion protein. In some embodiments, a PTD is covalently linked to the carboxyl terminus of a reference or CasX variant fusion protein. In some cases, the PTD is inserted internally in the sequence of a reference or CasX variant fusion protein at a suitable insertion site. In some cases, a reference or CasX variant fusion protein includes (is conjugated to, is fused to) one or more PTDs (e.g., two or more, three or more, four or more PTDs). In some cases, a PTD includes one or more nuclear localization signals (NLS). Examples of PTDs include but are not limited to peptide transduction domain of HIV TAT comprising YGRKKRRQRRR (SEQ ID NO: 183), RKKRRQRR (SEQ ID NO: 184); YARAAARQARA (SEQ ID NO: 185); THRLPRRRRRR (SEQ ID NO: 186); and GGRRARRRRRR (SEQ ID NO: 187); a polyarginine sequence comprising a number of arginines sufficient to direct entry into a cell (e.g., 3, 4, 5, 6, 7, 8, 9, 10, or 10-50 arginines (SEQ ID NO: 188)); a VP22 domain (Zender et al. (2002) Cancer Gene Ther. 9(6):489-96); an Drosophila Antennapedia protein transduction domain (Noguchi et al. (2003) Diabetes 52(7): 1732-1737); a truncated human calcitonin peptide (Trehin et al. (2004) Pharm. Research 21:1248-1256); polylysine (Wender et al. (2000) Proc. Natl. Acad. Sci. USA 97: 13003-13008); RRQRRTSKLMKR (SEQ ID NO: 189); Transportan GWTLNSAGYLLGKINL-KALAALAKKIL (SEQ ID NO: 190); KALAWEAK-LAKALAKALAKHLAKALAKALKCEA (SEQ ID NO: 191); and RQIKIWFQNRRMKWKK (SEQ ID NO: 192). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

In some embodiments, a reference or CasX variant fusion protein can include a CasX protein that is linked to an internally inserted heterologous amino acid or heterologous polypeptide (a heterologous amino acid sequence) via a linker polypeptide (e.g., one or more linker polypeptides). In some embodiments, a reference or CasX variant fusion protein can be linked at the C-terminal and/or N-terminal end to a heterologous polypeptide (fusion partner) via a linker polypeptide (e.g., one or more linker polypeptides) The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers are generally produced by using synthetic, linker-encoding oligonucleotides to couple the proteins. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use. Example linker polypeptides include glycine polymers (G)n, glycine-serine polymer (including, for example, (GS)n, GSGGSn (SEQ ID NO: 193), GGSGGSn (SEQ ID NO: 194), and GGGSn (SEQ ID NO: 195), where n is an integer of at least one), glycine-alanine polymers, alanine-serine polymers, glycine-proline polymers, proline polymers and proline-alanine polymers. Example linkers can comprise amino acid sequences including, but not limited to, GGSG (SEQ ID NO: 196), GGSGG (SEQ ID NO: 197), GSGSG (SEQ ID NO: 198), GSGGG (SEQ ID NO: 199), GGGSG (SEQ ID NO: 200), GSSSG (SEQ ID NO: 201), GPGP (SEQ ID NO: 202), GGP, PPP, PPAPPA (SEQ ID NO: 203), PPPGPPP (SEQ ID NO: 204) and the like. The ordinarily skilled artisan will recognize that design of a peptide conjugated to any elements described above can include linkers that are all or partially flexible, such that the linker can include a flexible linker as well as one or more portions that confer less flexible structure.

V. CasX:gNA Systems and Methods for Modification of SOD1 Genes

The CasX proteins, guide nucleic acids, and variants thereof provided herein are useful for various applications, including as therapeutics, diagnostics, and for research. To effect the methods of the disclosure for gene editing, provided herein are programmable CasX:gNA systems. The programmable nature of the CasX:gNA system provided herein allows for the precise targeting to achieve the desired effect (nicking, cleaving, etc.) at one or more regions of predetermined interest in the SOD1 gene target nucleic acid comprising one or more mutations. In some embodiments, the CasX:gNA systems provided herein comprise a CasX variant of Table 4 or a variant having at least 50%, at least 60%, at least 70%, at least 80%, or at least 90%, or at least 95%, or at least 99% sequence identity to a sequence of Table 4, and a gNA (e.g., a gNA variant comprising a sequence of Table 2B, or a variant having at least 50%, at least 60%, at least 70%, at least 80%, or at least 90%, or at least 95%, or at least 99% sequence identity to a sequence of Table 2B) or one or more polynucleotides encoding a CasX variant protein and a gNA, and further comprising a targeting sequence wherein the targeting sequence of the gNA is complementary to, and therefore is capable of hybridizing with, a SOD1 target nucleic acid. In the foregoing embodiment, the targeting sequence can be a sequence of Table 3, or a sequence having at least about 65%, at least about 75%, at least about 85%, or at least about 95% identity thereto. In some cases, the CasX:gNA system further comprises a donor template nucleic acid.

In some embodiments, the disclosure provides methods of modifying a SOD1 target nucleic acid comprising one or more mutations in a population of cells, the method comprising introducing into each cell of the population: a) a CasX:gNA system of any of the embodiments described herein; b) nucleic acid encoding a CasX:gNA system of any of the embodiments described herein; c) a vector comprising the nucleic acid of (b); d) a VLP comprising a CasX:gNA system of (a); or e) combinations of two or more of (a)-(d), wherein the SOD1 target nucleic acid sequence of the cells is modified by the CasX protein. In those cases where the CasX is delivered to the cell in the protein form and the gNA is delivered in the RNA form, the CasX and gNA can be pre-complexed and delivered as an RNP. In some embodiments of the method, the targeting sequence of the gNA is selected from a sequence of Table 3, or a sequence having at least about 65%, at least about 75%, at least about 85%, or at least about 95% identity thereto. Upon hybridization with the target nucleic acid by the CasX and the gNA, the CasX introduces one or more single-strand breaks or double-strand breaks within or near the SOD1 gene that result in a modification of the target nucleic acid such as a permanent indel (deletion or insertion), mutation, or correction in the target nucleic acid, as described herein, with a corresponding modulation of expression or alteration in the function of the SOD1 gene product, thereby creating an edited cell. In other embodiments, the method comprises contacting the target nucleic acid sequence with a plurality of gNAs targeted to different or overlapping portions of the SOD1 gene wherein the CasX protein introduces multiple breaks in the target nucleic acid sequence that result in a permanent indel (deletion or insertion), mutation, or correction in the target nucleic acid, as described herein, with a corresponding modulation of expression or alteration in the function of the SOD1 gene product, thereby creating an edited cell. In some embodiments, the method comprises insertion of a donor template into the break site(s) of the SOD1 target nucleic acid sequence of the cells of the population. Depending on whether the system is used to knock-down/knock-out a mutant form of SOD1 or is used to knock-in a corrective sequence, the donor template can be a short single-stranded or double-stranded oligonucleotide, or can be a long single-stranded or double-stranded oligonucleotide. For knock-down/knock-outs, the donor template sequence is typically not identical to the genomic sequence that it replaces. The donor template may contain one or more single base changes, insertions, deletions, inversions or rearrangements with respect to the genomic sequence, provided that there is sufficient homology with the target nucleic acid sequence to support homology-directed repair, which can result in a frame-shift or other mutation such that the non-functional SOD1 protein is not expressed or is expressed at a lower level. In some embodiments, the donor template sequence comprises a non-homologous sequence flanked by two regions of homology to the break sites of the target nucleic acid, facilitating insertion of the non-homologous sequence at the target region which can be mediated by homology-directed repair (HDR) or homology-independent targeted integration (HITI). In other cases, an exogenous donor template may comprise a corrective sequence, wherein the sequence is flanked by an upstream sequence and a downstream sequence with homology adjacent to the break sites in the target nucleic acid, facilitating insertion of the donor template sequence. In a particular embodiment of the foregoing, gNAs targeting the upstream sequence Exon 1 and Intron 1 can be used to introduce breaks that permit the insertion of full length cDNA encoding the SOD1 protein, replacing the mutated endogenous SOD1 gene and restoring protein expression. The exogenous sequence inserted by HITI can be any length, for example, a relatively short sequence of between 1 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity.

In some embodiments, the method of the disclosure provides CasX protein and gNA pairs that generate site-specific double strand breaks (DSBs) or single strand breaks (SSBs) (e.g., when the CasX protein is a nickase that can cleave only one strand of a target nucleic acid) within double-stranded DNA (dsDNA) target nucleic acids, which can then be repaired either by non-homologous end joining (NHEJ), homology-directed repair (HDR), homology-independent targeted integration (HITI), micro-homology mediated end joining (MMEJ), single strand annealing (SSA) or base excision repair (BER). In some cases, contacting a SOD1 gene with a gene editing pair occurs under conditions that are permissive for non-homologous end joining or homology-directed repair. Thus, in some cases, the methods provided herein include contacting the SOD1 gene with a donor template by introducing the donor template (either in vitro outside of a cell, in vitro inside a cell, in vivo inside a cell, or ex vivo), wherein the donor template, a portion of the donor template, a copy of the donor template, or a portion of a copy of the donor template integrates into the SOD1 gene to correct the one or more mutations or to replace the defective SOD1 gene. The donor template sequence may comprise certain sequence differences as compared to the genomic sequence, e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or, in some cases, may be used for other purposes (e.g., to signify expression at the targeted genomic locus). Alternatively, these sequence differences may include flanking recombination sequences such as FLPs, loxP sequences, or the like, that can be activated at a later time for removal of the marker sequence.

In those cases where the modification results in a knockdown or knock-out of the SOD1 gene, expression of the SOD1 protein is reduced by at least about 10%, at least about 20%, at least about 30%, at least about 40%, at least about 50%, at least about 60%, at least about 70%, at least about 80%, or at least about 90% in comparison to cells that have not been modified. In other cases, the SOD1 target nucleic acid of the cells of the population is modified such that expression of the SOD1 protein cannot be detected. In other cases, wherein the modification results in correction of the one or more mutations of the SOD1 gene in the cells of the population (e.g., insertion of a corrective donor template), the modification results in expression of functional SOD1 protein (e.g., the protein of SEQ ID NO: 100) by the modified cells. Expression of a SOD1 protein can be measured by flow cytometry, ELISA, cell-based assays or other methods know in the art (Lee, H., et al. Assay Development for High Content Quantification of SOD1 Mutant Protein Aggregate Formation in Living Cells. J Vis Exp. 128:56425 (2017)), or as described in the Examples.

In other embodiments of the method of modifying a target nucleic acid sequence, modifying the SOD1 gene comprises binding of a CasX to the target nucleic acid sequence without cleavage. In some embodiments, the CasX is a catalytically inactive CasX (dCasX) protein that retains the ability to bind to the gNA and to the SOD1 target nucleic acid sequence comprising the mutation but lacks the ability to cleave the nucleic acid sequence, thereby interfering with transcription of mutant SOD1 allele. In some embodiments, the dCasX comprises a mutation at residues D672, E769, and/or D935 corresponding to the CasX protein of SEQ ID NO:1 or D659, E756 and/or D922 corresponding to the CasX protein of SEQ ID NO: 2. In some embodiments, the mutation is a substitution of alanine or glycine for the residue.

In some embodiments of the method, the cells of the modified population are eukaryotic, which can include rodent cells, mouse cells, rat cells, primate cells, non-human primate cells, human cells, embryonic stem (ES) cells, induced pluripotent stem cell (iPSC), central nervous system (CNS) cells, and peripheral nervous system (PNS) cells. In the case of cells of the CNS, the cells can be neuron cells, which can include spinal motor neuron cells or oligodendrocyte cells. In the case of cells of the PNS, the cells can include glial cells or Schwann cells.

In some embodiments, the disclosure provides methods of modifying a SOD1 target nucleic acid in a population of cells by in vitro or ex vivo methods. In other embodiments, the disclosure provides methods of modifying a SOD1 target nucleic acid in a population of cells in vivo in a subject. In one embodiment of the method of in vivo modification, the method comprises administration of a vector of the embodiments described herein to the subject at a therapeutically effective dose. In one embodiment, the vector is administered to the subject at a dose of at least about $1\times10^8$ vector genomes (vg), at least about $1\times10^9$ vg, at least about $1\times10^{10}$ vg at least about $1\times10^{11}$ vg, or at least about $1\times10^{12}$ vg, or at least about $1\times10^{13}$ vg, or at least about $1\times10^{14}$ vg, or at least about $1\times10^{15}$ vg, or at least about $1\times10^{16}$ vg. In another embodiment of the method of in vivo modification, the method comprises administration of a VLP to the subject at a therapeutically effective dose. In one embodiment, the VLP is administered to the subject at a dose of at least about $1\times10^8$ particles, at least about $1\times10^9$ particles, at least about $1\times10^{10}$ particles at least about $1\times10^{11}$ particles, or at least about $1\times10^{12}$ particles, or at least about $1\times10^{13}$ particles, or at least about $1\times10^{14}$ particles, or at least about $1\times10^{15}$ particles, or at least about $1\times10^{16}$ particles. In the foregoing embodiments of the paragraph, the vector or VLP is administered to the subject by a route of administration selected from intraparenchymal, intravenous, intra-arterial, intracerebroventricular, intracisternal, intrathecal, intracranial, lumbar, intraperitoneal, or combinations thereof.

In some embodiments of the method of modifying a SOD1 target nucleic acid in a population of cells, the method further comprises contacting the target nucleic acid sequence of the population of cells with: a) an additional CRISPR nuclease and a gNA targeting a different or overlapping portion of the SOD1 target nucleic acid compared to the first gNA; b) a polynucleotide encoding the additional CRISPR nuclease and the gNA of (a); c) a vector comprising the polynucleotide of (b); or d) a VLP comprising the additional CRISPR nuclease and the gNA of (a), wherein the contacting results in modification of the SOD1 target nucleic acid at a different location in the sequence compared to the first gNA. In some cases, the additional CRISPR nuclease is a CasX protein having a sequence different from the CasX protein of any of the preceding claims. In other cases, the additional CRISPR nuclease is not a CasX protein. In other cases, the additional CRISPR nuclease is selected from the group consisting of Cas9, Cas12a, Cas12b, Cas12c, Cas12d (CasY), Cas13a, Cas13b, Cas13c, Cas13d, CasX, CasY, Cas14, Cpf1, C2c1, Csn2, Cas Phi, and sequence variants thereof.

Methods of introducing a nucleic acid (e.g., a nucleic acid comprising a donor polynucleotide sequence, one or more nucleic acids encoding a CasX protein and/or gNA, or a vector comprising same) into a cell are known in the art, and any convenient method can be used to introduce a nucleic acid (e.g., an expression construct) into a cell. Suitable methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, direct addition by cell penetrating CasX proteins that are fused to or recruit donor DNA, cell squeezing, calcium phosphate precipitation, direct microinjection, nanoparticle-mediated nucleic acid delivery, and the like.

In some embodiments of the method, a CasX can be provided as an RNA sequence. The RNA can be provided by direct chemical synthesis, or may be transcribed in vitro from a DNA (e.g., a DNA encoding an mRNA comprising a sequence encoding the CasX protein variant). Once synthesized, the RNA may, for example, be introduced into a cell by any of the well-known techniques for introducing nucleic acids into cells, including, but not limited to microinjection, electroporation, and transfection, for translation into the CasX protein.

Nucleic acids may be introduced into the cells using well-developed transfection techniques, and the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like.

In other embodiments, the disclosure provides a method of altering a SOD1 target nucleic acid sequence of a cell comprising one or more mutations in the target nucleic acid, comprising contacting said cell with a vector comprising a nucleic acid encoding a CasX:gNA system of the embodiments described herein, wherein the gNA comprises a targeting sequence complementary to the target nucleic acid, and therefore is capable of hybridizing with a sequence encoding the SOD1 protein or the SOD1 regulatory element comprising one or more mutations, or the complement of these sequences. In other embodiments of the method, the vector is a VLP comprising a CasX and gNA complexed in an RNP and, optionally, a donor template (described more fully, supra), wherein the VLP has tropism for the neuronal or glial cells and is able to deliver the RNP for the editing of the SOD1 gene, as described herein. The VLP embodiments utilized in the foregoing method of editing are described herein.

Introducing recombinant expression vectors comprising sequences encoding the CasX:gNA systems (and, optionally, the donor sequences) of the disclosure into cells under in vitro conditions can occur in any suitable culture media and under any suitable culture conditions that promote the survival of the cells. Introducing recombinant expression vectors into a target cell can be carried out in vivo, in vitro or ex vivo. In some embodiments of the method, vectors may be provided directly to a target host cell. For example, cells may be contacted with vectors comprising the subject nucleic acids (e.g., recombinant expression vectors having the donor template sequence and nucleic acid encoding the CasX and gNA) such that the vectors are taken up by the cells. Methods for contacting cells with nucleic acid vectors that are plasmids include electroporation, calcium chloride transfection, microinjection, and lipofection are well known in the art.

Vectors used for providing the nucleic acids encoding gNAs and/or CasX proteins to a target host cell can include suitable promoters for driving the expression, that is, transcriptional activation of the nucleic acid of interest. In some cases, the encoding nucleic acid of interest will be operably linked to a promoter. This may include ubiquitously acting promoters, for example, the CMV-beta-actin promoter, or inducible promoters, such as promoters that are active in particular cell populations or that respond to the presence of drugs such as tetracycline or kanamycin. By transcriptional activation, it is intended that transcription will be increased above basal levels in the target host cell comprising the vector by at least about 10-fold, by at least about 100-fold, more usually by at least about 1000-fold. In addition, vectors used for providing a nucleic acid encoding a gNA and/or a CasX protein to a cell may include nucleic acid sequences that encode for selectable markers in the target cells, so as to identify cells that have taken up the CasX protein and/or the gNA.

For viral vector delivery, cells can be contacted with viral particles comprising the subject viral expression vectors and the nucleic acid encoding the CasX and gNA and, optionally, the donor template. In some embodiments, the vector is an Adeno-Associated Viral (AAV) vector, wherein the AAV is selected from AAV1, AAV2, AAV3, AAV4, AAV5, AAV6, AAV7, AAV8, AAV9, AAV10, AAV-Rh74, or AAVRh10. In other embodiments, the vector is a retroviral vector. In other embodiments, the vector is a lentiviral vector. Retroviruses, for example, lentiviruses, may be suitable for use in methods of the present disclosure. Commonly used retroviral vectors are "defective", e.g., are unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, and this envelope protein determines the specificity or tropisms of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989). Nucleic acids can also be introduced by direct micro-injection (e.g., injection of RNA).

The present disclosure provides populations of cells modified by the foregoing methods. In some embodiments, the disclosure provides populations of modified cells wherein the cells have been modified such that at least 70%, at least 75%, at least 80%, at least 85%, at least 90%, or at least 95% of the modified cells do not express a detectable level of SOD1 protein. In other embodiments, the disclosure provides populations of modified cells wherein the cells have been modified such that the expression of SOD1 protein is reduced by at least 70%, at least 75%, at least 80%, at least 85%, at least 90%, or at least 95% compared to cells that have not been modified. In other embodiments, the disclosure provides populations of modified cells wherein the mutation of the SOD1 gene is corrected in the modified cells of the population, resulting in expression of functional SOD1 protein (e.g., the protein of SEQ ID NO: 100) by the modified cells. In some cases, the population of modified cells can be used in methods of treatment in a subject having a SOD1-related disorder, such as ALS, described more fully below.

VI. Polynucleotides and Vectors

In other embodiments, the present disclosure provides polynucleotides encoding the CasX proteins and the polynucleotides of the gNAs (e.g., the gDNAs and gRNAs) described herein, as well as sequences complementary to polynucleotides encoding the CasX proteins and the gNAs embodiments. In an additional embodiment, the disclosure provides donor template polynucleotides encoding portions or all of an SOD1 gene. In yet further embodiments, the disclosure relates to vectors comprising polynucleotides encoding the CasX proteins and the gNAs described herein. In yet further embodiments, the disclosure provides vectors comprising the donor templates described herein.

In some embodiments, the disclosure provides polynucleotide sequences encoding the reference CasX of SEQ ID NOS: 1-3. In other embodiments, the disclosure provides polynucleotide sequences encoding the CasX variants of any of the embodiments described herein, including the CasX protein variants of Table 4 or sequences having at least about 50%, at least about 60%, at least about 70%, at least about 80%, or at least about 90%, or at least about 95%, or at least about 96%, or at least about 97%, or at least about 98%, or at least about 99% sequence identity to a sequence of Table 4. In some embodiments, the disclosure provides an isolated polynucleotide sequence encoding a gNA sequence of any of the embodiments described herein, including the sequences of Tables 2A and 2B, together with the targeting sequences of Table 3.

In some embodiments, the polynucleotide encodes a gNA scaffold sequence set forth in Table 2A or Table 2B, or a sequence having at least about 50%, at least about 60%, at least about 70%, at least about 80%, at least about 90%, at least about 95%, at least about 96%, at least about 97%, at least about 98%, at least about 99% sequence identity thereto. In other embodiments, the disclosure provides a targeting sequence polynucleotide set forth in Table 3, or a sequence having at least about 65%, at least about 75%, at least about 85%, or at least about 95% identity to a sequence provided in Table 3. In some embodiments, the targeting sequence polynucleotide is, in turn, linked to the gNA scaffold sequence; either as a sgNA or a dgNA. In other embodiments, the disclosure provides a targeting polynucleotide having a sequence having one or more single nucleotide polymorphisms (SNP) relative to a sequence provided in Table 3.

In other embodiments, the disclosure provides an isolated polynucleotide sequence encoding a gNA comprising a targeting sequence that is complementary to, and therefore hybridizes with the SOD1 gene. In other embodiments, the polynucleotide sequence encodes a gNA comprising a targeting sequence that hybridizes with a SOD1 exon. In other embodiments, the polynucleotide sequence encodes a gNA comprising a targeting sequence that hybridizes with a SOD1 intron. In other embodiments, the polynucleotide sequence encodes a gNA comprising a targeting sequence that hybridizes with a SOD1 intron-exon junction. In other embodiments, the polynucleotide sequence encodes a gNA comprising a targeting sequence that hybridizes with an intergenic region of the SOD1 gene. In other embodiments, the polynucleotide sequence encodes a gNA comprising a targeting sequence that hybridizes with a SOD1 regulatory element. In some cases, the SOD1 regulatory element is 5' of the SOD1 gene. In other cases, the SOD1 regulatory element is 3' of the SOD1 gene. In some cases, the SOD1 regulatory element is in an intron of the SOD1 gene. In other cases, the SOD1 regulatory element comprises the 5' UTR of the SOD1 gene. In still other cases, the SOD1 regulatory element comprises the 3'UTR of the SOD1 gene. In some cases of the foregoing embodiment, the SOD1 sequence is a wild-type sequence. In other cases, the SOD1 sequence comprises one or more mutations.

In other embodiments, the disclosure provides donor template nucleic acids, wherein the donor template comprises a nucleotide sequence having homology to a SOD1 target nucleic acid sequence. In some embodiments, the SOD1 donor template is intended for gene editing and comprises at least a portion of a SOD1 gene. In some embodiments, the SOD1 donor template comprises a sequence that hybridizes with the SOD1 gene. In other embodiments, the SOD1 donor sequence comprises a sequence that encodes at least a portion of a SOD1 exon. In other embodiments, the SOD1 donor sequence has a sequence that encodes at least a portion of a SOD1 intron. In other embodiments, the SOD1 donor sequence has a sequence that encodes at least a portion of with a SOD1 intron-exon junction. In other embodiments, the SOD1 donor sequence has a sequence that encodes at least a portion of an intergenic region of the SOD1 gene. In other embodiments, the SOD1 donor sequence has a sequence that encodes at least a portion of a SOD1 regulatory element. In some cases of the foregoing donor template embodiments, the SOD1 sequence is a wild-type sequence that encodes all or a portion the SOD1 protein (e.g., the protein of SEQ ID NO: 100). In other cases, the SOD1 sequence comprises one or more mutations relative to a wild-type SOD1 gene. In the foregoing embodiments, the donor template ranges in size from 10-15,000 nucleotides. In some embodiments, the donor template is a single-stranded DNA template. In other embodiments, the donor template is a single stranded RNA template. In other embodiments, the donor template is a double-stranded DNA template.

In other aspects, the disclosure relates to methods to produce polynucleotide sequences encoding the reference CasX, the CasX variants, or the gNA of any of the embodiments described herein, or sequences complementary to the polynucleotide sequences, including homologous variants thereof, as well as methods to express the proteins expressed or RNA transcribed by the polynucleotide sequences. In general, the methods include producing a polynucleotide sequence coding for the reference CasX, the CasX variants, or the gNA of any of the embodiments described herein and incorporating the encoding gene into an expression vector appropriate for a host cell. For production of the encoded reference CasX, the CasX variants, or the gNA of any of the embodiments described herein, the methods include transforming an appropriate host cell with an expression vector comprising the encoding polynucleotide, and culturing the host cell under conditions causing or permitting the resulting reference CasX, the CasX variants, or the gNA of any of the embodiments described herein to be expressed or transcribed in the transformed host cell, thereby producing the reference CasX, the CasX variants, or the gNA, which are recovered by methods described herein or by standard purification methods known in the art. Standard recombinant techniques in molecular biology are used to make the polynucleotides and expression vectors of the present disclosure.

In accordance with the disclosure, nucleic acid sequences that encode the reference CasX, the CasX variants, or the gNA of any of the embodiments described herein (or their complement) are used to generate recombinant DNA molecules that direct the expression in appropriate host cells. Several cloning strategies are suitable for performing the present disclosure, many of which are used to generate a construct that comprises a gene coding for a composition of the present disclosure. In some embodiments, the cloning strategy is used to create a gene that encodes a construct that comprises nucleotides encoding the reference CasX, the CasX variants, or the gNA that is used to transform a host cell for expression of the composition.

In some approaches, a construct is first prepared containing the DNA sequence encoding a reference CasX, a CasX variant, or a gNA. Exemplary methods for the preparation of such constructs are described in the Examples. The construct is then used to create an expression vector suitable for transforming a host cell, such as a prokaryotic or eukaryotic host cell for the expression and recovery of the protein construct, in the case of the CasX, or the gNA. Where desired, the host cell is an *E. coli*. In other embodiments, the host cell is a eukaryotic cell. The eukaryotic host cell can be selected from Baby Hamster Kidney fibroblast (BHK) cells, human embryonic kidney 293 (HEK293), human embryonic kidney 293T (HEK293T), NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS), HeLa, Chinese hamster ovary (CHO), or yeast cells, or other eukaryotic cells known in the art suitable for the production of recombinant products. Exemplary methods for the creation of expression vectors, the transformation of host cells and the expression and recovery of reference CasX, the CasX variants, or the gNA are described in the Examples.

The gene encoding the reference CasX, the CasX variants, or the gNA constructs can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components (e.g., CasX and gNA) genes of a desired sequence. Genes encoding polypeptide compositions are assembled from oligonucleotides using standard techniques of gene synthesis.

In some embodiments, the nucleotide sequence encoding a CasX protein or a gNA is codon optimized. This type of optimization can entail a mutation of an encoding nucleotide sequence to mimic the codon preferences of the intended host organism or cell while encoding the same CasX protein or gNA. Thus, the codons can be changed, but the encoded protein or gNA remains unchanged. For example, if the intended target cell of the CasX protein was a human cell, a human codon-optimized CasX-encoding nucleotide sequence could be used. As another non-limiting example, if the intended host cell were a mouse cell, then a mouse codon-optimized CasX-encoding nucleotide sequence could be generated. As another non-limiting example, if the intended host cell were a plant cell, then a plant codon-optimized CasX protein variant-encoding nucleotide sequence could be generated. As another non-limiting example, if the intended host cell were an insect cell, then an insect codon-optimized CasX protein-encoding nucleotide sequence could be generated. The gene design can be performed using algorithms that optimize codon usage and amino acid composition appropriate for the host cell utilized in the production of the reference CasX, the CasX variants, or the gNA. In one method of the disclosure, a library of polynucleotides encoding the components of the constructs is created and then assembled, as described above. The resulting genes are then assembled and the resulting genes used to transform a host cell and produce and recover the reference CasX, the CasX variants, or the gNA compositions for evaluation of its properties, as described herein.

In some embodiments, a nucleotide sequence encoding a gNA is operably linked to a control element, e.g., a transcriptional control element, such as a promoter. In some embodiments, a nucleotide sequence encoding a CasX protein is operably linked to a control element, e.g., a transcriptional control element, such as a promoter. In other cases, the nucleotide encoding the CasX and gNA are linked and are operably linked to a single control element. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., neurons, spinal motor neurons, oligodendrocytes, or glial cells.

Non-limiting examples of eukaryotic promoters (promoters functional in a eukaryotic cell) include EF1alpha, EF1alpha core promoter, those from cytomegalovirus (CMV) immediate early, herpes simplex virus (HSV) thymidine kinase, early and late SV40, long terminal repeats (LTRs) from retrovirus, and mouse metallothionein-I. Further non-limiting examples of eukaryotic promoters include the CMV promoter full-length promoter, the minimal CMV promoter, the chicken β-actin promoter, the hPGK promoter, the HSV TK promoter, the Mini-TK promoter, the human synapsin I promoter which confers neuron-specific expression, the Mecp2 promoter for selective expression in neurons, the minimal IL-2 promoter, the Rous sarcoma virus enhancer/promoter (single), the spleen focus-forming virus long terminal repeat (LTR) promoter, the SV40 promoter, the SV40 enhancer and early promoter, the TBG promoter: promoter from the human thyroxine-binding globulin gene (Liver specific), the PGK promoter, the human ubiquitin C promoter, the UCOE promoter (Promoter of HNRPA2B1-CBX3), the Histone H2 promoter, the Histone H3 promoter, the U1 al small nuclear RNA promoter (226 nt), the U1b2 small nuclear RNA promoter (246 nt) 26, the TTR minimal enhancer/promoter, the b-kinesin promoter, the human eIF4A1 promoter, the ROSA26 promoter and the glyceraldehyde 3-phosphate dehydrogenase (GAPDH) promoter. In some embodiments, the promoter used in the gNA construct is U6 (Kunkel, G R et al. U6 small nuclear RNA is transcribed by RNA polymerase III. Proc Natl Acad Sci USA. 83(22):8575 (1986)).

Selection of the appropriate vector and promoter is well within the level of ordinary skill in the art, as it related to controlling expression, e.g., for modifying a SOD1 gene. The expression vector may also contain a ribosome binding site for translation initiation and a transcription terminator. The expression vector may also include appropriate sequences for amplifying expression. The expression vector may also include nucleotide sequences encoding protein tags (e.g., 6xHis tag, hemagglutinin tag, fluorescent protein, etc.) that can be fused to the CasX protein, thus resulting in a chimeric CasX protein that are used for purification or detection.

In some embodiments, a nucleotide sequence encoding a gNA variant and/or a CasX protein is operably linked to an inducible promoter, a constitutively active promoter, a spatially restricted promoter (i.e., transcriptional control element, enhancer, tissue specific promoter, cell type specific promoter, etc.), or a temporally restricted promoter.

In certain embodiments, suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6), an enhanced U6 promoter, a human HI promoter (HI), a POL1 promoter, a 7SK promoter, tRNA promoters and the like.

In some embodiments, a nucleotide sequence encoding a CasX and gNA and, optionally, a donor template, is operably linked to (under the control of) an inducible promoter operable in a eukaryotic cell. Examples of inducible promoters may include, but are not limited to, T7 RNA polymerase promoter, T3 RNA polymerase promoter, isopropyl-beta-D-thiogalactopyranoside (IPTG)—regulated promoter, lactose induced promoter, heat shock promoter, tetracycline-regulated promoter, kanamycin-regulated promoter, steroid-regulated promoter, metal-regulated promoter, estrogen receptor-regulated promoter, etc. Inducible promoters can therefore, in some embodiments, be regulated by molecules including, but not limited to, doxycycline; estrogen and/or an estrogen analog; IPTG; etc. Additional examples of inducible promoters include, without limitation, chemically/biochemically-regulated and physically-regulated promoters such as alcohol-regulated promoters, kanamycin-regulated promoters, tetracycline-regulated promoters (e.g., anhydrotetracycline (aTc)—responsive promoters and other tetracycline—responsive promoter systems, which include a tetracycline repressor protein (tetR), a tetracycline operator sequence (tetO) and a tetracycline transactivator fusion protein (tTA), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used as long as the promoter is functional in the targeted host cell (e.g., eukaryotic cell; prokaryotic cell).

In some cases, the promoter is a reversible promoter. Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR, etc.), tetracycline regulated promoters, (e.g., promoter systems including Tet Activators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Recombinant expression vectors of the disclosure can also comprise elements that facilitate robust expression of CasX proteins and/or transcription of gNAs of the disclosure. For example, recombinant expression vectors can include one or more of a polyadenylation signal (PolyA), an intronic sequence or a post-transcriptional regulatory element such as a woodchuck hepatitis post-transcriptional regulatory element (WPRE). Exemplary polyA sequences include hGH poly(A) signal (short), HSV TK poly(A) signal, synthetic polyadenylation signals, SV40 poly(A) signal, β-globin poly (A) signal and the like. A person of ordinary skill in the art will be able to select suitable elements to include in the recombinant expression vectors described herein.

The polynucleotides encoding the reference CasX, the CasX variants, or the gNA sequences can then be individually cloned into an expression vector. Vectors include bacterial plasmids, viral vectors, and the like. In some embodiments, the vector is a recombinant expression vector that comprises a nucleotide sequence encoding a CasX protein. In other embodiments, the disclosure provides a recombinant expression vector comprising a nucleotide sequence encoding a CasX protein and a nucleotide sequence encoding a gNA. In some cases, the nucleotide sequence encoding the CasX protein variant and/or the nucleotide sequence encoding the gNA are operably linked to a promoter that is operable in a cell type of choice. In other embodiments, the nucleotide sequence encoding the CasX protein variant and the nucleotide sequence encoding the gNA are provided in separate vectors.

In some embodiments, provided herein are one or more recombinant expression vectors comprising: (i) a nucleotide sequence of a donor template nucleic acid where the donor template comprises a nucleotide sequence having homology to a SOD1 sequence of a target nucleic acid (e.g., a target genome); (ii) a nucleotide sequence that encodes a gNA (e.g., gRNA), that hybridizes to a sequence of the target SOD1 locus of the targeted genome (e.g., configured as a single or dual guide RNA) operably linked to a promoter that is operable in a target cell such as a eukaryotic cell; and (iii) a nucleotide sequence encoding a CasX protein operably linked to a promoter that is operable in a target cell such as a eukaryotic cell. In some embodiments, the sequences comprising the donor template and encoding the gNA and the CasX proteins are in different recombinant expression vectors, and in other embodiments one or more or all three polynucleotide sequences (for the donor template, CasX and gNA) are in the same recombinant expression vector.

The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Once introduced into a suitable host cell, expression of the SOD1 can be determined using any nucleic acid or protein assay known in the art. For example, the presence of transcribed mRNA of reference CasX or the CasX variants can be detected and/or quantified by conventional hybridization assays (e.g., Northern blot analysis), amplification procedures (e.g. RT-PCR), SAGE (U.S. Pat. No. 5,695,937), and array-based technologies (see e.g., U.S. Pat. Nos. 5,405,783, 5,412,087 and 5,445,934), using probes complementary to any region of SOD1 polynucleotide.

The disclosure provides for the use of plasmid expression vectors containing replication and control sequences that are compatible with and recognized by the host cell and are operably linked to the gene encoding the polypeptide for controlled expression of the polypeptide or transcription of the RNA. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired. The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell.

The recombinant expression vectors can be delivered to the target host cells by a variety of methods, as described more fully, below. Such methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, direct addition by cell penetrating CasX proteins that are fused to or recruit donor DNA, cell squeezing, calcium phosphate precipitation, direct microinjection, nanoparticle-mediated nucleic acid delivery, and the like.

A recombinant expression vector sequence can be packaged into a virus or virus-like particle (also referred to herein as a "particle", or "virion") for subsequent infection and transformation of a cell, ex vivo, in vitro or in vivo. Such particles or virions will typically include proteins that encapsidate or package the vector genome. Suitable expression vectors may include viral expression vectors based on vaccinia virus; poliovirus; adenovirus; a retroviral vector (e.g., Murine Leukemia Virus), spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus; and the like. In some embodiments, a recombinant expression vector of the present disclosure is a recombinant adeno-associated virus (AAV) vector. In some embodiments, a recombinant expression vector of the present disclosure is a recombinant lentivirus vector. In some embodiments, a recombinant expression vector of the present disclosure is a recombinant retroviral vector.

AAV is a small (20 nm), nonpathogenic virus that is useful in treating human diseases in situations that employ a viral vector for delivery to a cell such as a eukaryotic cell, either in vivo or ex vivo for cells to be prepared for administration to a subject. A construct is generated, for example a construct encoding any of the CasX protein and/or gNA embodiments as described herein, and is flanked with AAV inverted terminal repeat (ITR) sequences, thereby enabling packaging of the AAV vector into an AAV viral particle.

An "AAV" vector may refer to the naturally occurring wild-type virus itself or derivatives thereof. The term covers all subtypes, serotypes and pseudotypes, and both naturally occurring and recombinant forms, except where required otherwise. As used herein, the term "serotype" refers to an AAV which is identified by and distinguished from other AAVs based on capsid protein reactivity with defined antisera, e.g., there are many known serotypes of primate AAVs. In some embodiments, the AAV vector is selected from AAV1, AAV2, AAV3, AAV4, AAV5, AAV6, AAV7, AAV8, AAV9, AAV 10, AAV-Rh74 (Rhesus macaque-derived AAV), and AAVRh10, and modified capsids of these serotypes. For example, serotype AAV-2 is used to refer to an AAV which contains capsid proteins encoded from the cap gene of AAV-2 and a genome containing 5' and 3' ITR sequences from the same AAV-2 serotype. Pseudotyped AAV refers to an AAV that contains capsid proteins from one serotype and a viral genome including 5'-3' ITRs of a second serotype. Pseudotyped rAAV would be expected to have cell surface binding properties of the capsid serotype and genetic properties consistent with the ITR serotype. Pseudotyped recombinant AAV (rAAV) are produced using standard techniques described in the art. As used herein, for example, rAAV1 may be used to refer an AAV having both capsid proteins and 5'-3' ITRs from the same serotype or it may refer to an AAV having capsid proteins from serotype 1 and 5'-3' ITRs from a different AAV serotype, e.g., AAV serotype 2. For each example illustrated herein the description of the vector design and production describes the serotype of the capsid and 5'-3' ITR sequences.

An "AAV virus" or "AAV viral particle" refers to a viral particle composed of at least one AAV capsid protein (preferably by all of the capsid proteins of a wild-type AAV) and an encapsidated polynucleotide. If the particle additionally comprises a heterologous polynucleotide (i.e., a polynucleotide other than a wild-type AAV genome to be delivered to a mammalian cell), it is typically referred to as "rAAV". An exemplary heterologous polynucleotide is a polynucleotide comprising a CasX protein and/or sgRNA and, optionally, a donor template of any of the embodiments described herein.

By "adeno-associated virus inverted terminal repeats" or "AAV ITRs" is meant the art recognized regions found at each end of the AAV genome which function together in cis as origins of DNA replication and as packaging signals for the virus. AAV ITRs, together with the AAV rep coding region, provide for the efficient excision and rescue from, and integration of a nucleotide sequence interposed between two flanking ITRs into a mammalian cell genome.

The nucleotide sequences of AAV ITR regions are known. See, for example Kotin, R. M. (1994) Human Gene Therapy 5:793-801; Berns, K. I. "Parvoviridae and their Replication" in Fundamental Virology, $2^{nd}$ Edition, (B. N. Fields and D. M. Knipe, eds.). As used herein, an AAV ITR need not have the wild-type nucleotide sequence depicted, but may be altered, e.g., by the insertion, deletion or substitution of nucleotides. Additionally, the AAV ITR may be derived from any of several AAV serotypes, including without limitation, AAV1, AAV2, AAV3, AAV4, AAV5, AAV6, AAV7, AAV8, AAV9, AAV10, AAV-Rh74, and AAVRh10, and modified capsids of these serotypes. Furthermore, 5' and 3' ITRs which flank a selected nucleotide sequence in an AAV vector need not necessarily be identical or derived from the same AAV serotype or isolate, so long as they function as intended, i.e., to allow for excision and rescue of the sequence of interest from a host cell genome or vector, and to allow integration of the heterologous sequence into the recipient cell genome when AAV Rep gene products are present in the cell. Use of AAV serotypes for integration of heterologous sequences into a host cell is known in the art (see, e.g., WO2018195555A1 and US20180258424A1, incorporated by reference herein.)

By "AAV rep coding region" is meant the region of the AAV genome which encodes the replication proteins Rep 78, Rep 68, Rep 52 and Rep 40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome.

By "AAV cap coding region" is meant the region of the AAV genome which encodes the capsid proteins VP1, VP2, and VP3, or functional homologues thereof. These Cap expression products supply the packaging functions which are collectively required for packaging the viral genome.

In some embodiments, AAV capsids utilized for delivery of the encoding sequences for the CasX and gNA, and, optionally, the SOD1 donor template nucleotides to a host cell can be derived from any of several AAV serotypes, including without limitation, AAV1, AAV2, AAV3, AAV4, AAV5, AAV6, AAV7, AAV8, AAV9, AAV10, AAV-Rh74 (Rhesus macaque-derived AAV), and AAVRh10, and the AAV ITRs are derived from AAV serotype 2.

In order to produce rAAV viral particles, an AAV expression vector is introduced into a suitable host cell using known techniques, such as by transfection. Packaging cells are typically used to form virus particles; such cells include HEK293 cells (and other cells known in the art), which package adenovirus. A number of transfection techniques are generally known in the art; see, e.g., Sambrook et al. (1989) Molecular Cloning, a laboratory manual, Cold Spring Harbor Laboratories, N.Y. Particularly suitable transfection methods include calcium phosphate co-precipitation, direct microinjection into cultured cells, electroporation, liposome mediated gene transfer, lipid-mediated transduction, and nucleic acid delivery using high-velocity microprojectiles.

In some embodiments, host cells transfected with the above-described AAV expression vectors are rendered capable of providing AAV helper functions in order to replicate and encapsidate the nucleotide sequences flanked by the AAV ITRs to produce rAAV viral particles. AAV helper functions are generally AAV-derived coding sequences which can be expressed to provide AAV gene products that, in turn, function in trans for productive AAV replication. AAV helper functions are used herein to complement necessary AAV functions that are missing from the AAV expression vectors. Thus, AAV helper functions include one, or both of the major AAV ORFs (open reading frames), encoding the rep and cap coding regions, or functional homologues thereof. Accessory functions can be introduced into and then expressed in host cells using methods known to those of skill in the art. Commonly, accessory functions are provided by infection of the host cells with an unrelated helper virus. In some embodiments, accessory functions are provided using an accessory function vector. Depending on the host/vector system utilized, any of a number of suitable transcription and translation control elements, including constitutive and inducible promoters, transcription enhancer elements, transcription terminators, etc., may be used in the expression vector.

In other embodiments, suitable vectors may include virus-like particles (VLP). Virus-like particles (VLPs) are particles that closely resemble viruses, but do not contain viral genetic material and are therefore non-infectious. In some embodiments, VLPs comprise a polynucleotide encoding a transgene of interest, for example any of the CasX protein and/or a gNA embodiments, and, optionally, SOD1 donor template polynucleotides, described herein, packaged with one or more viral structural proteins. In other embodiments, the VLP comprise a CasX and gNA complexed as an RNP and, optionally, a donor template comprising all or a portion of the SOD1 gene to either knock-down/knock-out the SOD1 gene or a portion of the gene to correct the one or more mutations of the SOD1 gene by insertion via HDR or HITI mechanisms.

In other embodiments, the disclosure provides VLPs produced in vitro that comprise a CasX:gNA RNP complex of the CasX and gNA of any of the embodiments described herein and, optionally, a donor template. Combinations of structural proteins from different viruses can be used to create VLPs, including components from virus families including Parvoviridae (e.g., adeno-associated virus), Retroviridae (e.g., HIV), Flaviviridae (e.g., Hepatitis C virus), Paramyxoviridae (e.g., Nipah) and bacteriophages (e.g., Qβ, AP205). In some embodiments, the disclosure provides VLP systems designed using components of retrovirus, including lentiviruses such as HIV, in which individual plasmids comprising nucleic acids encoding the various components are introduced into a packaging cell that, in turn, produce the VLP. In some embodiments, the disclosure provides VLP having an HIV capsid that contains a CasX:gNA RNP wherein upon administration and entry into a target cell, the RNP molecule is free to be transported into the nucleus of the cell. The foregoing offers advantages over other vectors in the art in that viral transduction to dividing and non-dividing cells is efficient and that the VLP delivers potent and short-lived RNP that escape a subject's immune surveillance mechanisms that would otherwise detect a foreign protein. In some embodiments, a system to make VLP in a host cell comprises nucleic acids encoding one or more components selected from i) a gag polyprotein or portions thereof; ii) a CasX protein of any of the embodiments described herein; iii) a protease cleavage site; iv) a protease; v) a gNA of any of the embodiments described herein (including the targeting sequence); vi) a pol polyprotein or portions thereof; and vii) a pseudotyping glycoprotein or antibody fragment that provides for binding and fusion of the VLP to a target cell. The envelope protein or glycoprotein can be derived from any enveloped viruses known in the art to confer tropism to VLP, including but not limited to the group consisting of Argentine hemorrhagic fever virus, Australian bat virus, *Autographa californica* multiple nucleopolyhedrovirus, Avian leukosis virus, baboon endogenous virus, Bolivian hemorrhagic fever virus, Borna disease virus, Breda virus, Bunyamwera virus, Chandipura virus, Chikungunya virus, Crimean-Congo hemorrhagic fever virus, Dengue fever virus, Duvenhage virus, Eastern equine encephalitis virus, Ebola hemorrhagic fever virus, Ebola Zaire virus, enteric adenovirus, Ephemerovirus, Epstein-Bar virus (EBV), European bat virus 1, European bat virus 2, Fug Synthetic gP Fusion, Gibbon ape leukemia virus, Hantavirus, Hendra virus, hepatitis A virus, hepatitis B virus, hepatitis C virus, hepatitis D virus, hepatitis E virus, hepatitis G Virus (GB virus C), herpes simplex virus type 1, herpes simplex virus type 2, human cytomegalovirus (HHV5), human foamy virus, human herpesvirus (HHV), human Herpesvirus 7, human herpesvirus type 6, human herpesvirus type 8, human immunodeficiency virus 1 (HIV-1), human metapneumovirus, human T-lymphotro pic virus 1, influenza A, influenza B, influenza C virus, Japanese encephalitis virus, Kdposi's sarcoma-associated herpesvirus (HHV8), Kdysanur Forest disease virus, La Crosse virus, Lagos bat virus, Lassa fever virus, lymphocytic choriomeningitis virus (LCMV), Machupo virus, Marburg hemorrhagic fever virus, measles virus, Middle eastern respiratory syndrome-related coronavirus, Mokola virus, Moloney murine leukemia virus, monkey pox, mouse mammary tumor virus, mumps virus, murine gammaherpesvirus, Newcastle disease virus, Nipah virus, Nipah virus, Norwalk virus, Omsk hemorrhagic fever virus, papilloma virus, parvovirus, pseudorabies virus, Quaranfil virus, rabies virus, RD114 Endogenous Feline Retrovirus, respiratory syncytial virus (RSV), Rift Valley fever virus, Ross River virus, rRotavirus, Rous sarcoma virus, rubella virus, Sabia-associated hemorrhagic fever virus, SARS-associated coronavirus (SARS-CoV), Sendai virus, Tacaribe virus, Thogotovirus, tick-borne encephalitis causing virus, varicella zoster virus (HHV3), varicella zoster virus (HHV3), variola major virus, variola minor virus, Venezuelan equine encephalitis virus, Venezuelan hemorrhagic fever virus, vesicular stomatitis virus (VSV), VSV-G, Vesiculovirus, West Nile virus, western equine encephalitis virus, and Zika Virus. In some embodiments, the packaging cell used for the production of VLP is selected from the group consisting of HEK293 cells, Lenti-X 293T cells, BHK cells, HepG2 cells, Saos-2 cells, HuH7 cells, NS0 cells, SP2/0 cells, YO myeloma cells, A549 cells, P3X63 mouse myeloma cells, PER cells, PER.C$_6$ cells, hybridoma cells, VERO cells, NIH3T3 cells, COS cells, WI38 cells, MRC5 cells, A549 cells, HeLa cells, CHO cells, or HT1080 cells.

VII. Cells

In still another aspect, provided herein are populations of cells comprising a wild-type or a modified SOD1 gene modified by any of the CasX:gNA system or method embodiments described herein. Cells that have been genetically modified in this way may be administered to a subject for purposes such as gene therapy, e.g., to treat a disease associated with a defect in the SOD1 gene.

In some embodiments, the disclosure provides populations of cells modified by introducing into each cell of the population: a) a CasX:gNA system of any of the embodiments described herein; b) nucleic acid encoding a CasX: gNA system of any of the embodiments described herein; c) a vector comprising the nucleic acid of (b); d) a VLP comprising a CasX:gNA system of (a); or e) combinations of two or more of (a)-(d), wherein the SOD1 target nucleic acid sequence of the cells is modified by the CasX protein. In some embodiments, the disclosure provides a population of cells wherein the cells have been modified such that at least 70%, at least 75%, at least 80%, at least 85%, at least 90%, or at least 95% of the modified cells do not express a detectable level of SOD1 protein. In other embodiments, the disclosure provides a population of cells wherein the cells have been modified such that the expression of SOD1 protein is reduced by at least 70%, at least 75%, at least 80%, at least 85%, at least 90%, or at least 95% compared to cells that have not been modified. In still other embodiments, the disclosure provides a population of cells wherein the mutation of the SOD1 gene is corrected in the modified cells of the population, resulting in expression of a functional SOD1 protein by the modified cells. The effects of the modification can be assessed by ELISA assays, the assays of the examples, or conventional assays known in the art.

In those cases where the CasX is delivered to the cells in the protein form and the gNA is delivered in the RNA form, the CasX and gNA can be pre-complexed and delivered as an RNP. In some embodiments, the targeting sequence of the gNA used to target the SOD1 gene of the cells is selected from a sequence of Table 3, or a sequence having at least about 65%, at least about 75%, at least about 85%, or at least about 95% identity thereto. Upon hybridization with the target nucleic acid by the CasX and the gNA, the CasX introduces one or more single-strand breaks or double-strand breaks within or near the SOD1 gene that results in a modification of the target nucleic acid such as a permanent indel (deletion or insertion) or a mutation in the target nucleic acid that, in connection with the repair mechanisms of the host cell, result in a correction or a compensation of the mutation, with a corresponding expression of functional SOD1 protein, thereby creating the modified population of cells. In other embodiments, the target nucleic acid of the cells is modified using a plurality of gNAs (e.g., two, three, four or more) targeted to different or overlapping portions of the SOD1 gene wherein the CasX protein introduces multiple breaks in the target nucleic acid sequence that result in a permanent indel (deletion or insertion) or corrective mutation. In some embodiments, the disclosure provides populations of cells modified by contacting the SOD1 gene with a CasX, one or more gNA, and a donor template comprising a corrective sequence, wherein the donor template sequence is flanked by an upstream sequence and a downstream sequence with homology adjacent to the break sites in the target nucleic acid, facilitating insertion of the donor template sequence in order to correct the mutation(s) in the population of cells. In one embodiment, the disclosure provides populations of cells that have been modified to express the SOD1 protein of SEQ ID NO: 100. The donor template can be a short single-stranded or double-stranded oligonucleotide, or can be a long single-stranded or double-stranded oligonucleotide. The insertion of the donor template at the target region which can be mediated by homology-directed repair (HDR) or homology-independent targeted integration (HITI). The exogenous sequence inserted by HITI can be any length, for example, a relatively short sequence of between 1 and 50 nucleotides in length, or a longer sequence of about 50-1000 nucleotides in length. The donor template sequence may comprise certain sequence differences as compared to the genomic sequence, e.g., restriction sites, nucleotide polymorphisms, barcodes, selectable markers (e.g., drug resistance genes, fluorescent proteins, enzymes etc.), etc., which may be used to assess for successful insertion of the donor nucleic acid at the cleavage site or, in some cases, may be used for other purposes (e.g., to signify expression at the targeted genomic locus). Alternatively, these sequence differences may include flanking recombination sequences such as FLPs, loxP sequences, or the like, that can be activated at a later time for removal of the marker sequence.

A cell that can serve as a recipient for a CasX variant protein and/or gNA of the present disclosure and/or a nucleic acid comprising a nucleotide sequence encoding a CasX variant protein and/or a gNA variant and, optionally, a donor template, can be any of a variety of cells, including, e.g., in vitro cells; in vivo cells; ex vivo cells; primary cells; cancer cells; animal cells; etc. A cell can be a recipient of a CasX RNP of the present disclosure. A cell can be a recipient of a single component of a CasX system of the present disclosure. In certain embodiments, as provided herein, a cell can be an in vitro cell (e.g., established cultured cell line including, but not limited to HEK293 cells, BHK cells, NS0 cells, SP2/0 cells, YO myeloma cells, P3X63 mouse myeloma cells, PER cells, PER.C6 cells, hybridoma cells, NIH3T3 cells, COS, HeLa, or CHO cells). A cell can be an ex vivo cell (cultured cell from an individual). A cell can be an in vivo cell (e.g., a cell in an individual). A cell can be an isolated cell. A cell can be a cell in a cell culture (e.g., in vitro cell culture). A cell can be one of a collection of cells. A cell can be a eukaryotic cell or derived from a eukaryotic cell. A cell can be an animal cell or derived from an animal cell. A cell can be a mammalian cell or derived from a mammalian cell. A cell can be a rodent cell or derived from a rodent cell. A cell can be a non-human primate cell or derived from a non-human primate cell. A cell can be a human cell or derived from a human cell. A cell can be autologous with respect to the subject to be administered the cells. A cell can be allogenic with respect to the subject to be administered the cells.

The populations of modified cells have utility in the treatment of a SOD1-related disorder, including administration of the population of cells to a subject having a SOD1-related disorder such as ALS. In other embodiments, the disclosure provides populations of modified cells for use in methods to provide functional SOD1 in a subject. In some cases, the modified cell is a cell of the central nervous system (CNS) or peripheral nervous system (PNS). In some embodiments, the modified cell is a neuron. In some embodiments, the modified cell is a spinal motor neuron. In other cases, the modified cell is a glial cell, an oligodendrocyte, or a Schwann cell. In some embodiments, the populations of modified cells are eukaryotic, which can include rodent cells, mouse cells, rat cells, primate cells, non-human primate cells, human cells, embryonic stem (ES) cells, or induced pluripotent stem cells (iPSC). In some embodiments, the population of cells are autologous with respect to the subject to be administered the cells. In other embodiments, the population of cells are allogenic with respect to the subject to be administered the cells. Thus, the CasX:gNA systems and methods described herein can be used to modify a variety of cells in which mutations in SOD1 are associated with disease, e.g., stem cells, cells of the central nervous system (CNS) or peripheral nervous system (PNS), to produce a cell in which the SOD1 comprising mutations is corrected. This approach, therefore, could be used for methods of treatment in a subject with a disease such as ALS.

VIII. Applications

The CasX:gNA systems comprising CasX proteins, guides, and variants thereof provided herein are useful in methods for modifying SOD1 target nucleic acid in various applications, including therapeutics, diagnostics, and research.

In the methods of modifying a SOD1 target nucleic acid, the method utilizes any of the embodiments of the CasX:gNA system described herein, and optionally include a donor template described herein. In some embodiments, the method results in reducing or eliminating expression of the mutant allele at the protein level by introduction of a mutation in the mutant allele in the SOD1 gene by an insertion, substitution or deletion resulting from cleavage of the SOD1 gene by the CasX:gNA system followed by non-homologous end joining (NHEJ), micro-homology mediated end joining (MMEJ), single strand annealing (SSA), base excision repair (BER), or other repair mechanisms. In other embodiments, the method results in correction of the mutation in the SOD1 gene by cleavage of the SOD1 gene by the CasX:gNA system followed by insertion of corrective nucleotides by homology-directed repair (HDR), homology-independent targeted integration (HITI), or other repair mechanisms, resulting in the expression of functional SOD1 protein. In other embodiments, the method results in correction of the mutation in the SOD1 gene by cleavage of the SOD1 gene by the CasX:gNA system followed by insertion, or knocking-in, SOD1 cDNA into the SOD1 gene locus using a donor template, resulting in the expression of functional SOD1 protein.

In some embodiments, the method comprises contacting the target nucleic acid with a CasX protein and a guide nucleic acid (gNA) comprising a targeting sequence wherein said contacting results in modification of the target nucleic acid by the CasX protein.

In some embodiments, the method comprises introducing into a cell the CasX protein or a nucleic acid encoding the CasX protein and the gNA or the nucleic acid encoding the gNA, wherein the target nucleic acid sequence comprises a SOD1 gene and wherein the targeting sequence comprises a sequence complementary to a portion of the SOD1 gene at or near the mutation wherein the contacting results in the modification of the SOD1 gene.

In some embodiments, the method comprises introducing into a cell the CasX protein or a nucleic acid encoding the CasX protein and the gNA or the nucleic acid encoding the gNA, wherein the target nucleic acid comprises a superoxide dismutase 1 (SOD1) gene and wherein the targeting sequence comprises a sequence complementary to a portion of the SOD1 gene, wherein the contacting results in the modification of the SOD1 gene. In some embodiments, the targeting sequence of the gNA comprises a sequence of Table 3, or a sequence having at least about 65%, at least about 75%, at least about 85%, or at least about 95% identity to a sequence selected from the group consisting of sequences set forth in Table 3. In some embodiments, the scaffold of the gNA comprises a sequence of SEQ ID NOS: 4, 5 or 2101-2241, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. In some embodiments, the CasX protein is a CasX variant protein of any of the embodiments described herein, or a reference CasX protein SEQ ID NO: 1, SEQ ID NO: 2, or SEQ ID NO: 3.

In some embodiments of the method of modifying a SOD1 target nucleic acid, the target nucleic acid comprises a superoxide dismutase 1 (SOD1) gene having one or more mutations, and the targeting sequence of the gNA has a sequence that is complementary to, and therefore can hybridize with the SOD1 gene. In some cases, the SOD1 gene has a wild-type nucleic acid sequence. In other embodiments, the method comprises contacting the target nucleic acid with a plurality (e.g., two or more) of gNAs targeted to different or overlapping regions of the SOD1 gene with one or more mutations. In some embodiments of the method, the target nucleic acid is a DNA. In some embodiments of the method, the target nucleic acid is an RNA. In some embodiments, the gNA is a guide RNA (gRNA). In some embodiments, the gNA is a guide DNA (gDNA). In some embodiments, the gNA is a single-molecule gNA (sgNA). In other embodiments, the gNA is a dual-molecule gNA (dgNA). In some embodiments, the gNA is a chimeric gRNA-gDNA. In some embodiments, the method comprises contacting the target nucleic acid with a pre-complexed CasX protein-gNA (i.e., an RNP). In some embodiments, the SOD1 gene comprise a mutation and the modifying comprises introducing a single-stranded break in the target nucleic acid. In other embodiments, the SOD1 gene comprise a mutation and the modifying comprises introducing a double-stranded break in the target nucleic acid. In the foregoing, the resulting modification can be an insertion, deletion, substitution, duplication, or inversion of one or more nucleotides as compared to the wild-type sequence. In some embodiments, the modification corrects a gain of function mutation. In other embodiments, the modification corrects a loss of function mutation. The mutations to be modified can be one or more mutations that disrupt the function of the SOD1 protein, including the mutations of Table 1 or mutations of the SOD1 regulatory element.

In some embodiments, the method of modifying a target nucleic acid comprises contacting a SOD1 gene with a CasX protein and gNA pair and a donor template comprising a corrective sequence that can be inserted or knocked-in at the break site introduced by the CasX. For example, an exogenous donor template which may comprise a corrective sequence (or a deletion or insertion to knock-out the defective sequence) to be integrated is flanked by an upstream sequence and a downstream sequence with homology to the target nucleic acid to facilitate its introduction into a cell. In some embodiments, the donor template ranges in size from 10-10,000 nucleotides. In other embodiments, the donor template ranges in size from 100-1,000 nucleotides. In some embodiments, the donor template is a single-stranded DNA template or a single stranded RNA template. In other embodiments, the donor template is a double-stranded DNA template.

In some embodiments of the method, the CasX is a catalytically inactive CasX (dCasX) protein that retains the ability to bind to the gNA and the target nucleic acid sequence comprising the mutation, thereby interfering with transcription of mutant SOD1. In some embodiments, the method comprises contacting a SOD1 gene with a CasX protein and gNA and does not comprise contacting the target nucleic acid with a donor template polynucleotide, and the target nucleic acid is cleaved by the CasX nuclease and is modified such that nucleotides within the target nucleic acid are deleted or inserted according to the cells own repair pathways. In some embodiments, the editing occurs in vitro, inside of a cell, for example in a cell culture system. In some embodiments, the editing occurs in vivo inside of a cell, for example in a cell in an organism or subject. In some embodiments, the editing occurs ex vivo inside of a cell. In some embodiments, the cell is a eukaryotic cell. Exemplary eukaryotic cells may include cells selected from the group consisting of a plant cell, a fungal cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell. In some embodiments, the cell is a human cell. In some embodiments, the cell is a non-human primate cell. In some embodiments of the method, the cell is a cell of a central nervous system (CNS) or peripheral nervous system (PNS). In some embodiments, the cell is a neuron. In other embodiments, the neuron is a spinal motor neuron. In other embodiments, the cell is a glial cell, an oligodendrocyte, or a Schwann cell.

Methods of introducing a nucleic acid (e.g., a nucleic acid comprising a donor polynucleotide sequence, one or more nucleic acids encoding a CasX protein and/or gNA) into a cell are known in the art, and any convenient method can be used to introduce a nucleic acid (e.g., an expression construct) into a cell. Suitable methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, direct addition by cell penetrating CasX proteins that are fused to or recruit donor DNA, cell squeezing, calcium phosphate precipitation, direct microinjection, nanoparticle-mediated nucleic acid delivery, and the commercially available TransMessenger® reagents from Qiagen, Stemfect™ RNA Transfection Kit from Stemgent, the TransIT®-mRNA Transfection Kit from Mirus Bio LLC, Lonza nucleofection, or Maxagen electroporation and the like. Introducing recombinant expression vectors into cells under in vitro conditions can occur in any suitable culture media and under any suitable culture conditions that promote the survival of the cells. Introducing recombinant expression vectors into a target cell can be carried out in vivo, or in vitro.

Retroviruses, for example, lentiviruses, may be suitable for use in methods of the present disclosure. Commonly used retroviral vectors are "defective", e.g., are unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, and this envelope protein determines the specificity of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989). Nucleic acids can also be introduced by direct micro-injection (e.g., injection of RNA).

In other embodiments, the disclosure relates to methods to produce CasX proteins and nucleic acids encoding the CasX compositions of any of the embodiments described herein, or sequences complementary to the polynucleotide sequences, including homologous variants thereof, as well as methods to express the CasX proteins expressed by the polynucleotide sequences. A CasX protein of the present disclosure may be produced in vitro or by eukaryotic cells or by prokaryotic cells. For production by host cells, in general, the methods include producing a polynucleotide sequence coding for the CasX proteins of any of the embodiments described herein and incorporating the encoding gene into an expression vector appropriate for a host cell. For production of the encoded CasX proteins of any of the embodiments described herein, the method includes transforming an appropriate host cell with an expression vector, and culturing the host cell under conditions causing or permitting the resulting CasX protein to be expressed in the transformed host cell, thereby producing the CasX protein, which is recovered by methods described herein or by standard protein purification methods known in the art. Standard recombinant techniques in molecular biology are used to make the polynucleotides and expression vectors of the present disclosure.

In some embodiments of the method of altering a SOD1 target nucleic acid of a cell, to induce cleavage or any desired modification to a target nucleic acid (e.g., genomic DNA), or any desired modification to a polypeptide associated with the target SOD1 gene, the gNA and/or the CasX protein of the present disclosure and/or the donor template sequence, whether they be introduced as nucleic acids or polypeptides, are provided to the cells for about 30 minutes to about 24 hours, or at least about 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 4 days, e.g., every 1.5 days, every 2 days, every 3 days, or any other frequency from about every day to about every four days. The agent(s) may be provided to the subject cells one or more times, e.g., one time, twice, three times, or more than three times, and the cells allowed to incubate with the agent(s) for some amount of time following each contacting event e.g., 30 minutes to about 24 hours. In the case of in vitro-based methods, after the incubation period with the CasX and gNA (and optionally the donor template), the media is replaced with fresh media and the cells are cultured further.

In embodiments in which two or more different targeting complexes are provided to the cell (e.g., two gNAs comprising two or more different targeting sequences that are complementary to different or overlapping sequences within the same or different regions of the SOD1 gene and/or targeting region), the complexes may be provided simultaneously (e.g., as two polypeptides and/or nucleic acids), or delivered simultaneously. Alternatively, they may be provided consecutively, e.g., the targeting complex being provided first, followed by the second targeting complex, etc. or vice versa.

To improve the delivery of a DNA vector into a target cell, the DNA can be protected from damage and its entry into the cell facilitated, for example, by using lipoplexes and polyplexes. Thus, in some cases, a nucleic acid of the present disclosure (e.g., a recombinant expression vector of the present disclosure) can be covered with lipids in an organized structure like a micelle or a liposome. When the organized structure is complexed with DNA it is called a lipoplex. There are three types of lipids, anionic (negatively-charged), neutral, or cationic (positively-charged). Lipoplexes that utilize cationic lipids have proven utility for gene transfer. Cationic lipids, due to their positive charge, naturally complex with the negatively charged DNA. Also, as a result of their charge, they interact with the cell membrane. Endocytosis of the lipoplex then occurs, and the DNA is released into the cytoplasm. The cationic lipids also protect against degradation of the DNA by the cell.

Complexes of polymers with DNA are referred to as polyplexes. Most polyplexes consist of cationic polymers and their production is regulated by ionic interactions. One large difference between the methods of action of polyplexes and lipoplexes is that polyplexes cannot release their DNA load into the cytoplasm, so to this end, co-transfection with endosome-lytic agents (to lyse the endosome that is made during endocytosis) such as inactivated adenovirus must occur. However, this is not always the case; polymers such as polyethylenimine have their own method of endosome disruption as does chitosan and trimethylchitosan.

Dendrimers, a highly branched macromolecule with a spherical shape, may be also be used to genetically modify stem cells. The surface of the dendrimer particle may be functionalized to alter its properties. In particular, it is possible to construct a cationic dendrimer (i.e., one with a positive surface charge). When in the presence of genetic material such as a DNA plasmid, charge complementarity leads to a temporary association of the nucleic acid with the cationic dendrimer. On reaching its destination, the dendrimer-nucleic acid complex can be taken up into a cell by endocytosis.

IX. Therapeutic Methods

In another aspect, the present disclosure relates to methods of treating a SOD1-related disease in a subject in need thereof, including but not limited to ALS or peripheral neuropathy. In some cases, the allele related to the SOD1-related disorder of the subject to be modified comprises one or more mutations, examples of which have been disclosed, supra. A number of therapeutic strategies have been used to design the compositions for use in the methods of treatment of a subject with a SOD1-related disorder. In some embodiments, the disclosure provides methods of treating a SOD1-related disease in a subject in need thereof in which repression or elimination of expression of the mutant SOD1 protein by modifying the SOD1 gene in target cells of the subject ameliorates the signs, symptoms, or effects of the disease. In such embodiments, the method comprises administering to the subject a therapeutically effective dose of any of the embodiments disclosed herein of: i) the CasX:gNA system comprising a first CasX protein and a first gNA with a targeting sequence complementary to the target nucleic acid and, optionally a donor template; ii) a nucleic acid encoding the CasX:gNA system of (i); iii) a vector comprising the nucleic acid of (ii); a VLP comprising the CasX:gNA system of (i); or iv) combinations thereof, wherein said administering results in 1) modification of the SOD1 target nucleic acid sequence by the CasX protein and, optionally, the donor template; and 2) decreased or elimination of expression of the mutant SOD1 protein in the modified cells of the subject. The methods are described more fully, below.

In some embodiments, the disclosure provides methods of treating a SOD1-related disease in a subject in need thereof in which correction of the mutant SOD1 gene in target cells of the subject ameliorates the signs, symptoms, or effects of the disease. In such embodiments, the method comprises administering to the subject a therapeutically effective dose of any of the embodiments disclosed herein of: i) the CasX:gNA system comprising a first CasX protein and a first gNA with a targeting sequence complementary to the target nucleic acid and, optionally a donor template; ii) a nucleic acid encoding the CasX:gNA system of (i); iii) a vector comprising the nucleic acid of (ii); a VLP comprising the CasX:gNA system of (i); or iv) combinations thereof, wherein said administering results in 1) modification of the SOD1 target nucleic acid sequence by the CasX protein and, optionally, the donor template; and 2) expression of functional SOD1 protein in the modified cells of the subject. In still other embodiments, the disclosure provides a method of treating a SOD1-related disease in a subject in need thereof by ex vivo modification of a mutant SOD1 target nucleic acid in a populations of cells to correct the mutation and administration of a therapeutically effective dose of the cells to the subject, resulting in amelioration of the signs, symptoms, or effects of the disease. The methods are described more fully, below.

In some embodiments, the targeting sequence of the gNA used to target the specific sequence of the SOD1 gene of the cells is selected from a sequence of Table 3, or a sequence having at least about 65%, at least about 75%, at least about 85%, or at least about 95% identity thereto. In some embodiments, the targeting sequence of the gNA has a sequence that hybridizes with a SOD1 exon. In some embodiments, the targeting sequence of the gNA has a sequence that hybridizes with a SOD1 intron. In some embodiments, the targeting sequence of the gNA has a sequence that hybridizes with a SOD1 intron-exon junction. In other embodiments, the targeting sequence of the gNA has a sequence that hybridizes with one or more single nucleotide polymorphisms (SNP) of the SOD1 gene. In some embodiments, the targeting sequence of the gNA has a sequence that hybridizes with an intergenic region of the SOD1 gene. In some embodiments, the targeting sequence of the gNA has a sequence that hybridizes with a SOD1 regulatory element. In some embodiments, the targeting sequence of the gNA has a sequence complementary to the SOD1 regulatory element, wherein the SOD1 regulatory element is 5' of the SOD1 gene. In some embodiments, the targeting sequence of the gNA has a sequence complementary to the SOD1 regulatory element, wherein the SOD1 regulatory element comprises the 5' untranslated region (UTR) of the SOD1 gene. In some embodiments, the targeting sequence of the gNA has a sequence complementary to the SOD1 regulatory element, wherein the SOD1 regulatory element is 3' of the SOD1 gene. In some embodiments, the targeting sequence of the gNA has a sequence complementary to the SOD1 regulatory element, wherein the SOD1 regulatory element comprises the 3'UTR of the SOD1 gene. In some embodiments, the targeting sequence of the gNA has a sequence complementary to the SOD1 regulatory element, wherein the SOD1 regulatory element comprises a promoter. In some embodiments, the targeting sequence of the gNA has a sequence complementary to the SOD1 regulatory element, wherein the SOD1 regulatory element comprises an enhancer. In some cases, the gNA used in the method of treatment is chemically modified. The CasX proteins utilized in the methods of treating a SOD-1 related disorder described herein can be selected from the CasX protein sequences of SEQ ID NOS: 1-3 or Table 4, or sequences having at least about 50%, at least about 60%, at least about 70%, at least about 80%, or at least about 90%, or at least about 95%, or at least about 99% sequence identity to the CasX proteins of SEQ ID NOS:1-3 or Table 4. In some cases, the CasX protein and the gNA utilized in the method of treatment are associated together in a ribonuclear protein complex (RNP).

Upon hybridization with the target nucleic acid by the CasX and the gNA, the CasX introduces one or more single-strand breaks or double-strand breaks within or near the SOD1 gene that results in a modification of the target nucleic acid. In those cases where the method of treatment is intended to knock-down or knock-out the mutant SOD1 gene in the cells of the subject, the CasX:gNA system is designed to modify the target nucleic acid by introducing a permanent indel (deletion or insertion) or a mutation in the target nucleic acid that, together with the host cell repair mechanisms, results in reduced expression of the defective SOD1. In some cases, the expression of the SOD1 protein is reduced by at least about 10%, at least about 20%, at least about 30%, at least about 40%, at least about 50%, at least about 60%, at least about 70%, at least about 80%, or at least about 90% in comparison to cells that have not been modified. In other cases, the SOD1 target nucleic acid of the cells of the subject are modified such that expression of the SOD1 protein cannot be detected. In those cases where the method of treatment is intended to correct the mutant SOD1 gene in the cells of the subject, the CasX:gNA system is designed to modify the target nucleic acid by introducing a permanent indel (deletion or insertion) or a mutation in the target nucleic acid that, together with the host cell repair mechanisms, corrects or compensates for the mutation, with a corresponding expression of functional SOD1 protein by the modified cells.

In other embodiments, the target nucleic acid of the cells of the subject is modified using a CasX and a plurality of gNAs (e.g., two, three, four or more) targeted to different or overlapping portions of the SOD1 gene wherein the CasX protein introduces multiple breaks in the target nucleic acid sequence. Similarly, as described supra, in those cases where the method of treatment is intended to knock-down or knock-out the mutant SOD1 gene in the cells of the subject, the CasX:gNA system is designed to modify the target nucleic acid by introducing one or more permanent indels (deletion or insertion) or mutations in the target nucleic acid that, together with the host cell repair mechanisms, results in reduced expression of the defective SOD1. In those cases where the method of treatment is intended to correct the mutant SOD1 gene in the cells of the subject, the CasX:gNA system is designed to modify the target nucleic acid by introducing one or more permanent indels (deletion or insertion) or mutations in the target nucleic acid that, together with the host cell repair mechanisms, results in correction or compensates for the mutation, with a corresponding expression of functional SOD1 protein by the modified cells.

In some embodiments, the disclosure provides methods of treating a SOD1-related disorder in a subject in need thereof comprising modifying the SOD1 gene with a CasX, one or more gNA, and a donor template, wherein the donor template sequence is flanked by an upstream sequence and a downstream sequence with homology adjacent to the break sites in the target nucleic acid introduced by the CasX, facilitating insertion of the donor template sequence. In those cases where the method of treatment is intended to knock-down or knock-out the mutant SOD1 gene in the cells of the subject, the donor template sequence is typically not identical to the genomic sequence that it replaces and may contain one or more single base changes, insertions, deletions, inversions or rearrangements with respect to the genomic sequence, provided that there is sufficient homology with the target nucleic acid sequence to support homology-directed repair or insertion by HITI, which can result in a frame-shift or other mutation such that the non-functional SOD1 protein is not expressed the expression of the mutant SOD1 is reduced by at least about 10%, at least about 20%, at least about 30%, at least about 40%, at least about 50%, at least about 60%, at least about 70%, at least about 80%, at least about 90% in comparison to cells that have not been modified. In those cases where the method of treatment is intended to correct the mutant SOD1 gene in the cells of the subject, the donor template comprises all or a portion of the wild-type SOD1 gene such that its insertion by HDR or HITI results in correction or compensates for the mutation, with a corresponding expression of functional SOD1 protein by the modified cells. In a particular embodiment of the foregoing, gNAs targeting the upstream sequence Exon 1 and Intron 1 can be used to introduce breaks that permit the insertion of full length cDNA encoding the SOD1 protein, replacing the mutated endogenous SOD1 gene and restoring protein expression of functional SOD1; e.g., the protein of SEQ ID NO:100. The donor template inserted by HITI can be any length, for example, a relatively short sequence of between 1 and 50 nucleotides in length, or a longer sequence of about 50-1000 nucleotides in length. The donor template can be a short single-stranded or double-stranded oligonucleotide, or can be a long single-stranded or double-stranded oligonucleotide. The donor template of the embodiments can be designed to encode a SOD1 exon, a SOD1 intron, a SOD1 intron-exon junction, a SOD1 regulatory element, or an intergenic region. The donor template sequence may comprise certain sequence differences as compared to the genomic sequence, e.g., restriction sites, nucleotide polymorphisms, barcodes, selectable markers (e.g., drug resistance genes, fluorescent proteins, enzymes etc.), etc., which may be used to assess for successful insertion of the donor nucleic acid at the cleavage site or, in some cases, may be used for other purposes (e.g., to signify expression at the targeted genomic locus). Alternatively, these sequence differences may include flanking recombination sequences such as FLPs, loxP sequences, or the like, that can be activated at a later time for removal of the marker sequence.

In other embodiments of the method of treatment, the method further comprises administration to the cells of a subject an additional CRISPR protein, or a polynucleotide (or a vector comprising the polynucleotide) encoding the additional CRISPR protein. In the foregoing embodiment, the additional CRISPR protein has a sequence different from the first CasX protein of the method. In some embodiments, the additional CRISPR protein is not a CasX protein; the additional CRISPR nuclease is selected from the group consisting of Cas9, Cas12a, Cas12b, Cas12c, Cas12d (CasY), Cas13a, Cas13b, Cas13c, Cas13d, CasX, CasY, Cas14, Cpf1, C2c1, Csn2, Cas Phi, and sequence variants thereof.

In some embodiments, the method comprises administering to the subject the compositions of the embodiments described herein (i.e., the CasX protein, the one or more gNA, and, optionally the donor template, or the one or more polynucleotides encoding the CasX protein, the gNA and the donor template) at a therapeutically effective dose via an administration route selected from the group consisting of intraparenchymal, intravenous, intra-arterial, intracerebroventricular, intracisternal, intrathecal, intracranial, lumbar, and intraperitoneal routes. In some embodiments of the methods of treating a SOD1-related disorder in a subject, the subject is selected from the group consisting of mouse, rat, non-human primate, and human. In a particular embodiment, the subject is a human. In some embodiments, the cell to be modified by the administration of the compositions is a cell of the central nervous system (CNS) or the peripheral nervous system (PNS). In some embodiments, the cell is a neuron. In some embodiments, the neuron is a spinal motor neuron. In other embodiments, the cell is a glial cell, an oligodendrocyte, or a Schwann cell.

In some embodiments of the method of treatment, the method comprises administration to the subject a therapeutically effective dose of a vector comprising polynucleotides encoding the CasX protein and the gNA, wherein the contacting of the cells of the subject with the vector results in expression of the CasX and gNA and modification of the target nucleic acid of the cells by the CasX:gNA complex. The vectors disclosed herein may be delivered to a subject by several technologies including DNA injection (also referred to as DNA vaccination) with and without in vivo electroporation, liposome mediated, nanoparticle facilitated, or use of recombinant vectors such as recombinant lentivirus, recombinant adenovirus, and recombinant adenovirus associated virus. In some embodiments, the method comprises administration of the vector comprising a polynucleotide encoding a CasX and a plurality of gNAs targeted to the SOD1 gene wherein the administration results in contacting the subject target nucleic acid within cells of the subject with the expression product(s) of the vectors wherein the SOD1 gene is modified in the cell of the subject. In other embodiments of the method of treatment, the method comprises contacting the cell with a vector encoding the CasX protein and the gNA and further comprising a donor template wherein said contacting results in modification of the target nucleic acid of the cell by cleavage by the CasX protein and insertion of the donor template into the target nucleic acid. In other embodiments of the method of treatment, the method comprises contacting the cell with a first vector encoding the CasX protein and the gNA and a second vector comprising the donor template. In other embodiments, the method comprises administration of the vector comprising a polynucleotide encoding a CasX and a plurality of gNAs targeted to the SOD1 gene and a second vector comprising a donor template polynucleotide encoding at least a portion of or the entirety of a SOD1 gene wherein the administration of the vectors results in contacting the subject target nucleic acid within a cell of the subject with the expression product(s) of the CasX and gNA vectors and the donor template wherein the SOD1 gene is modified in the cell of the subject. In some cases, wherein the CasX:gNA system is designed to correct the SOD1 mutation, the donor template is a SOD1 gene or a gene portion selected from a SOD1 exon, a SOD1 intron, a SOD1 intron-exon junction, or a SOD1 regulatory element and wherein the donor template comprises a corrective sequence that is inserted into the target nucleic acid of the subject. In other cases, wherein the CasX:gNA system is designed to knock-down/knock-out the SOD1 gene, the donor template comprises one or more single base changes, insertions, deletions, inversions or rearrangements with respect to the genomic sequence mutations in the SOD1 gene portion, whereupon insertion of the donor template the gene is knocked-down or knocked-out. In some embodiments, the vector is a viral particle. In some embodiments, the vector is an AAV vector (described supra). The vectors of the embodiments are administered to the subject at a therapeutically effective dose. In some embodiments, the vector is administered at a dose of at least about $1\times10^{10}$ vector genomes (vg), or at least about $1\times10^{11}$ vg, or at least about $1\times10^{12}$ vg, or at least about $1\times10^{13}$ vg, or at least about $1\times10^{14}$ vg, or at least about $1\times10^{15}$ vg, or at least about $1\times10^{16}$ vg. In other embodiments, the subject is administered a dose of at least about $1\times10^{10}$ to about $1\times10^{16}$ vg.

In other embodiments of the method of treatment, the method comprises administration to the subject a therapeutically effective dose of a VLP comprising the CasX protein and the gNA and, optionally, the donor template (described, supra), wherein the contacting of the cells of the subject with the VLP results in modification of the target nucleic acid of the cells by the CasX:gNA complex. In some embodiments, the method comprises administration of the VLP comprising a CasX and a plurality of gNAs targeted to different locations in the SOD1 gene, wherein the contacting of the cells of the subject with the VLP results in modification of the target nucleic acid of the cells by the CasX:gNA complexes. As previously described, the components can be designed to knock-down/knock-out the SOD1 gene or to knock-in a corrective sequence. The VLP of the embodiments are administered to the subject at a therapeutically effective dose. In some embodiments, the VLP is administered to the subject at a dose of at least about $1\times10^{8}$ particles, at least about $1\times10^{9}$ particles, at least about $1\times10^{10}$ particles at least about $1\times10^{11}$ particles, or at least about $1\times10^{12}$ particles, or at least about $1\times10^{13}$ particles, or at least about $1\times10^{14}$ particles, or at least about $1\times10^{15}$ particles, or at least about $1\times10^{16}$ particles.

In some embodiments, the vectors or VLP may be administered to a subject by various routes, wherein the route of administration is selected from the group consisting of intraparenchymal, intravenous, intra-arterial, intracerebroventricular, intracisternal, intrathecal, intracranial, lumbar, and intraperitoneal routes. In some embodiments of the method of treatment, the vector or VLP is delivered to the central nervous system of the subject. In some embodiments, the vector or VLP is delivered to a brain region. Areas of the brain contemplated for delivery include, but are not limited to, the motor cortex and the brain stem. In some embodiments, the vector or VLP is delivered to the spinal cord. In certain embodiments, the vector or VLP is delivered to the cerebrospinal fluid. In some embodiments of the method, the vector or VLP is delivered to the peripheral nervous system region. In some embodiments, the vector or VLP is delivered to nerve and glial cells, including those of the central nervous system and the peripheral nervous system. In some embodiments, the glial cell is a microglial cell, an oligodendrocyte or an astrocyte. In some embodiments of the method, the polynucleotide is delivered to a Schwann cell. In the embodiments, the vector or VLP may be administered according to a treatment regimen comprising one or more consecutive doses using a therapeutically effective dose of the vector. In some embodiments of the treatment regimen, the therapeutically effective dose of the vector or VLP is administered as a single dose. In other embodiments of the treatment regimen, the therapeutically effective dose of the vector or VLP is administered to the subject as two or more doses over a period of at least two weeks, or at least one month, or at least two months, or at least three months, or at least four months, or at least five months, or at least six months, or on an annual basis, or every 2 or 3 years.

In some embodiments, the disclosure provides methods of treating a SOD1-related disorder (e.g., ALS) in a subject comprising administering to the subject a therapeutically effective dose of a population of modified eukaryotic cells of the disclosure, the cells comprising a modified SOD1 gene in which the mutations have been corrected or in which a wild-type SOD1 sequence is inserted such that the cells produce functional SOD1. In some embodiments, the population of cells are autologous with respect to the subject to be administered the cells. In other embodiments, the population of cells are allogenic with respect to the subject to be administered the cells. In some embodiments, the population of modified cells is selected from the group consisting of embryonic stem (ES) cells, induced pluripotent stem cell (iPSC), central nervous system (CNS) cells, and peripheral nervous system (PNS) cells. In some embodiments, the population of cells comprise neuron cells of the CNS or the PNS. In some cases, the neuron cells comprise spinal motor neuron cells or oligodendrocyte cells. In other embodiments, the population of cells comprise glial cells or Schwann cells of the PNS. The cells can be derived from a subject selected from the group consisting of rodent, mouse, rat, non-human primate, and human. In the embodiments, the population of cells can be administered according to a treatment regimen comprising one or more consecutive doses using a therapeutically effective dose of the cells. In some embodiments of the treatment regimen, the therapeutically effective dose of the cells is administered as a single dose. In other embodiments of the treatment regimen, the therapeutically effective dose of the cells is administered to the subject as two or more doses over a period of at least two weeks, or at least one month, or at least two months, or at least three months, or at least four months, or at least five months, or at least six months, or on an annual basis, or every 2 or 3 years. In the embodiments, the route of administration is selected from intraparenchymal, intravenous, intra-arterial, intracerebroventricular, intracisternal, intrathecal, intracranial, lumbar, intraperitoneal, or combinations thereof. This approach, therefore, could be used for methods of treatment in a subject with a SOD1-related disease such as ALS.

In some embodiments, the administration of the therapeutically effective amount of a vector, a VLP, a CasX-gNA composition, or a plurality of modified cell embodiments disclosed herein to the subject leads to the prevention or amelioration of the underlying SOD1-related disorder (e.g., ALS) such that an improvement is observed in the subject, notwithstanding that the subject may still be afflicted with the underlying disorder. In some embodiments, the administration of the therapeutically effective amount of the vector, the VLP, the CasX-gNA composition or the modified cells leads to an improvement in at least one clinically-relevant endpoint selected from the group consisting of ALS Functional Rating Scale (ALSFRS-(R)), combined assessment of function and survival, time to death, time to tracheostomy or persistent assisted ventilation (DTP), forced vital capacity (% FVC), manual muscle test, maximum voluntary isometric contraction, duration of response, progression-free survival, time to progression of disease, and time-to-treatment failure. In some embodiments, the administration of the therapeutically effective amount of the vector, the VLP, the CasX-gNA composition or the modified cells leads to an improvement in at least two clinically-relevant endpoints selected from the group consisting of ALS Functional Rating Scale (ALSFRS-(R)), combined assessment of function and survival, time to death, time to tracheostomy or persistent assisted ventilation (DTP), forced vital capacity (% FVC), manual muscle test, maximum voluntary isometric contraction, duration of response, progression-free survival, time to progression of disease, and time-to-treatment failure. In the embodiments of the foregoing, the subject is a mammal selected from mouse, rat, non-human primate, and human. Several mouse models expressing mutant forms of SOD1 exist. Transgenic mouse models expressing the human SOD1 gene harboring a G93A, G37R, or G85R mutation develop a phenotype similar to what is observed in human ALS patients; the transgenic SOD1 mouse is considered the most accurate representation of the disease process (Gurney M E, et al. Motor neuron degeneration in mice that express a human Cu, Zn superoxide dismutase mutation. Science. 264:1772 (1994); Philips, T and Jeffrey D. Rothstein, J. Rodent Models of Amyotrophic Lateral Sclerosis. Curr Protoc Pharmacol. 69: 5.67.1-5.67.21. (2015).

In some embodiments, the disclosure provides compositions comprising CasX and gNA gene editing pairs, for use as a medicament for the treatment of a subject having a SOD1 related disorder, such as ALS. In the foregoing, the CasX can be a CasX variant of Table 4 and the gNA can be a gNA variant of Table 3. In other embodiments, the disclosure provides compositions of vectors comprising or encoding the gene editing pairs of CasX and gNA for use as a medicament for the treatment of a subject having a SOD1 related disorder, such as ALS.

X. Kits and Articles of Manufacture

In another aspect, provided herein are kits comprising the compositions of the embodiments described herein. In some embodiments, the kit comprises a CasX protein and one or a plurality of gNA of any of the embodiments of the disclosure comprising a targeting sequence region specific for a SOD1 gene, optionally a donor template, and a suitable container (for example a tube, vial or plate). In other embodiments, the kit comprises a nucleic acid encoding a CasX protein and one or a plurality of gNA of any of the embodiments of the disclosure comprising a targeting sequence region specific for a SOD1 gene, optionally a donor template, and a suitable container. In other embodiments, the kit comprises a vector comprising a nucleic acid encoding a CasX protein and one or a plurality of gNA of any of the embodiments of the disclosure comprising a targeting sequence region specific for a SOD1 gene, and a suitable container. In still other embodiments, the kit comprises a VLP comprising a CasX protein and one or a plurality of gNA of any of the embodiments of the disclosure comprising a targeting sequence region specific for a SOD1 gene, optionally a donor template, and a suitable container.

In some embodiments, the kit further comprises a buffer, a nuclease inhibitor, a protease inhibitor, a liposome, a therapeutic agent, a label, a label visualization reagent, or any combination of the foregoing. In some embodiments, the kit further comprises a pharmaceutically acceptable carrier, diluent or excipient.

In some embodiments, the kit comprises appropriate control compositions for gene modifying applications, and instructions for use.

The present description sets forth numerous exemplary configurations, methods, parameters, and the like. It should be recognized, however, that such description is not intended as a limitation on the scope of the present disclosure, but is instead provided as a description of exemplary embodiments.

XI. Enumerated Embodiments

Embodiments of the present subject matter described above may be beneficial alone or in combination, with one or more other embodiments. Without limiting the foregoing description, certain non-limiting enumerated embodiments of the disclosure, numbered 1-234 are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiment explicitly provided below:
Set 1

Embodiment 1. A method of modifying a target nucleic acid, the method comprising contacting the target nucleic acid with a CasX polypeptide and a guide nucleic acid (gNA) comprising a targeting sequence wherein said contacting results in modification of the target nucleic acid by the CasX protein, and wherein said contacting comprises introducing into a cell:

a) the CasX protein or a nucleic acid encoding the CasX protein; and b) the gNA or a nucleic acid encoding the gNA, wherein the target nucleic acid comprises a superoxide dismutase 1 (SOD1) gene and/or a SOD1 regulatory element, and wherein the targeting sequence comprises i) a sequence complementary to a portion of the SOD1 gene and/or the SOD1 regulatory element; or ii) a sequence complementary to a complement of the portion of the SOD1 gene and/or SOD1 regulatory element.

Embodiment 2. The method of 1, further comprising a second gNA or a nucleic acid encoding the second gNA, wherein the second gNA has a targeting sequence complementary a different portion of the target nucleic acid or its complement.

Embodiment 3. The method of 1, wherein the target nucleic acid is a target DNA.

Embodiment 4. The method of any one of 1-3, wherein the gNA is a guide RNA (gRNA), a guide DNA (gDNA), or a chimera comprising DNA and RNA.

Embodiment 5. The method of any one of 1-4, wherein the gNA comprises at least one modification relative to a reference gRNA sequence having the sequence of SEQ ID NO:2102.

Embodiment 6. The method of 5, wherein the at least one modification of the reference gRNA comprises at least one substitution, deletion, or substitution of a nucleotide of the gRNA sequence.

Embodiment 7. The method of any one of 1-4, wherein the gNA comprises any one of the sequences listed in Tables 2A or 2B.

Embodiment 8. The method of any one of the preceding embodiments, wherein the CasX polypeptide and the gNA are associated together in a ribonuclear protein complex (RNP).

Embodiment 9. The method of any one of the preceding embodiments, wherein the CasX protein comprises at least one modification relative to a reference CasX protein having a sequence selected from SEQ ID NOS: 1-3.

Embodiment 10. The method of 9, wherein the at least one modification of the reference CasX protein comprises at least one amino acid substitution, deletion, or substitution in a domain of the reference CasX protein.

Embodiment 11. The method of 10, wherein the at least one modification of the reference Cas X protein comprises at least one amino acid deletion in a domain of the reference CasX protein.

Embodiment 12. The method of 10, wherein the at least one modification of the reference Cas X protein comprises at least one amino acid insertion in a domain of the reference CasX protein.

Embodiment 13. The method of 10, wherein the at least one modification of the reference Cas X protein comprises at least one amino acid substitution in a domain of the reference CasX protein.

Embodiment 14. The method of any one of 1-13, wherein the CasX protein comprises a sequence selected from the sequences of Table 4 or a sequence having at least about 50%, at least about 60%, at least about 70%, at least about 80%, or at least about 90%, or at least about 95%, or at least about 99% sequence identity to a sequence of Table 4.

Embodiment 15. The method of any one of the preceding embodiments, wherein the one or more nucleic acids encoding the CasX protein and the gNA are capable of being expressed in a cell.

Embodiment 16. The method of any one of the preceding wherein the CasX protein exhibits at least one or more improved characteristics as compared to a reference CasX protein.

Embodiment 17. The method of 16, wherein the improved characteristic is selected from the group consisting of improved folding of the Cas X protein, improved binding affinity to the guide RNA, improved binding affinity to the target nucleic acid, altered binding affinity to one or more PAM sequences, improved unwinding of the target nucleic acid, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved protein:guide RNA complex stability, improved protein solubility, improved protein:guide RNA complex solubility, improved protein yield, improved protein expression, and improved fusion characteristics.

Embodiment 18. The method of 16 or 17, wherein the improved characteristic of the CasX protein is at least about 1.1 to about 100,000 times improved relative to the reference protein of SEQ ID NO: 1, SEQ ID NO: 2, or SEQ ID NO: 3.

Embodiment 19. The method of 16 or 17, wherein the improved characteristics of the CasX protein is at least about 10 to about 100 times improved relative to the reference protein of SEQ ID NO: 1, SEQ ID NO: 2, or SEQ ID NO:3.

Embodiment 20. The method of 16 or 17, wherein the improved characteristic of the CasX protein is at least about 1.1 to about 100 times increased binding affinity of the CasX protein to the gNA compared to the protein of SEQ ID NO: 1, SEQ ID NO: 2, or SEQ ID NO: 3.

Embodiment 21. The method of 16 or 17, wherein the CasX protein has at least about 1.1 to about 2 times increased binding affinity to the target nucleic acid compared to the protein of SEQ ID NO: 1, SEQ ID NO: 2, or SEQ ID NO: 3.

Embodiment 22. The method of any one of the preceding embodiments, wherein the modifying of the target nucleic acid occurs inside of a cell.

Embodiment 23. The method of 22, wherein the modifying of the target nucleic acid occurs in vivo.

Embodiment 24. The method of 22, wherein the modifying of the target nucleic acid occurs in vitro.

Embodiment 25. The method of any one of 22-24, wherein the cell is a eukaryotic cell.

Embodiment 26. The method of 25, wherein the eukaryotic cell is selected from the group consisting of a plant cell, a fungal cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell.

Embodiment 27. The method of 25, wherein the eukaryotic cell is a human cell.

Embodiment 28. The method of any one of 22-25 or 27, wherein the cell is a cell of a central nervous system (CNS) or peripheral nervous system (PNS).

Embodiment 29. The method of 28, wherein the cell is a neuron.

Embodiment 30. The method of 29, wherein the neuron is a spinal motor neuron.

Embodiment 31. The method of 28, wherein the cell is a glial cell, an oligodendrocyte, or a Schwann cell.

Embodiment 32. The method of any one of the preceding embodiments, wherein the CasX protein is selected from the CasX proteins provided in SEQ ID NOS: 1-3 or Table 4 or sequences having at least about 50%, at least about 60%, at least about 70%, at least about 80%, or at least about 90%, or at least about 95%, or at least about 99% sequence identity to the CasX proteins of SEQ ID NOS:1-3 or Table 4.

Embodiment 33. The method of any one of the preceding embodiments, wherein the CasX protein has binding affinity for a PAM sequence selected from the group consisting of TTC, ATC, GTC, and CTC.

Embodiment 34. The method of any one of the preceding embodiments, wherein the CasX protein comprises nickase activity.

Embodiment 35. The method any one of the preceding embodiments, wherein the method comprises modifying the SOD1 gene or the SOD1 regulatory element in a cell.

Embodiment 36. The method of 35, wherein the modifying comprises introducing a single-stranded break in the target nucleic acid, and wherein modification of the SOD1 gene or the SOD1 regulatory element comprises a mutation, an insertion, or a deletion in the SOD1 gene or the SOD1 regulatory element.

Embodiment 37. The method of 35, wherein the modifying comprises introducing a double-stranded break in the target nucleic acid, and wherein modification of the SOD1 gene or the SOD1 regulatory element comprises a mutation, an insertion, or a deletion.

Embodiment 38. The method of any one of 1-35, wherein the CasX protein is a catalytically inactive CasX (dCasX) protein, and wherein the dCasX and the gNA retain the ability to bind to the target nucleic acid.

Embodiment 39. The method of 38, wherein the dCasX comprises a mutation at residues:
i) D672, E769, and/or D935 corresponding to the CasX protein of SEQ ID NO:1; or
ii) D659, E756 and/or D922 corresponding to the CasX protein of SEQ ID NO: 2.

Embodiment 40. The method of 39 wherein the mutation is a substitution of alanine for the residue.

Embodiment 41. The method of any one of 1 to 40, wherein the SOD1 gene and/or the SOD1 regulatory element to be modified comprises a polynucleotide encoding all or a portion of the sequence of SEQ ID NO:100, or comprises a polynucleotide sequence that spans bp 31,659,622 to bp 31,668,931 of chromosome 21 of the human genome (GRCh38/hg38).

Embodiment 42. The method of any one of 1 to 40, wherein the SOD1 gene and/or the SOD1 regulatory element to be modified comprises a wild type sequence.

Embodiment 43. The method of any one of 1 to 40, wherein the SOD1 gene and/or the SOD1 regulatory element to be modified comprises a mutation.

Embodiment 44. The method of 43, wherein the mutation is a gain of function mutation.

Embodiment 45. The method of 43, wherein the mutation is a loss of function mutation.

Embodiment 46. The method of 43, wherein the SOD1 gene encodes a polypeptide comprising a mutation selected from mutations set forth in Table 1 or comprises one or more mutations that disrupt the function of the SOD1 polypeptide.

Embodiment 47. The method of 46, wherein the SOD1 gene encodes a polypeptide comprising an A4V mutation of SEQ ID NO:100, a D90A mutation of SEQ ID NO:100, a G93A mutation of SEQ ID NO:100, or a combination thereof.

Embodiment 48. The method of any one of 43-47, wherein the modification comprises correction of the mutation to wild-type sequence.

Embodiment 49. The method of any one of 43-47, wherein the modification comprises altering or suppressing expression of the SOD1 comprising the mutation.

Embodiment 50. The method of any one of 1-49, wherein the targeting sequence of the gNA consists of 14, 15, 16, 17, 18, 19, 20, 21, 22, 23, 24, 25, 26, 27, 28, 29, or 30 consecutive nucleotides.

Embodiment 51. The method of any one of 1-50, wherein the targeting sequence of the gNA consists of 20 nucleotides.

Embodiment 52. The method of any one of 1-51, wherein the targeting sequence of the gNA comprises a sequence having at least about 65%, at least about 75%, at least about 85%, or at least about 95% identity to a sequence provided in Table 3.

Embodiment 53. The method of any one of 1-52, wherein the targeting sequence of the gNA comprises a sequence having one or more single nucleotide polymorphisms (SNP) relative to a sequence provided in Table 3.

Embodiment 54. The method of 52 or 53, wherein the targeting sequence encodes a mutation of the SOD1 polypeptide of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T, and one or more mutations that disrupt the function or expression of the SOD1 polypeptide.

Embodiment 55. The method of any one of the preceding embodiments, wherein the gNA is chemically modified.

Embodiment 56. The method of any one of the preceding embodiments, wherein the targeting sequence of the gNA is complementary to the SOD1 gene or its regulatory element, or complementary to the complement of the SOD1 gene or its regulatory element.

Embodiment 57. The method of 56, wherein the targeting sequence of the gNA has a sequence that is a sequence of a SOD1 exon or a sequence complementary to a SOD1 exon.

Embodiment 58. The method of 56, wherein the targeting sequence of the gNA has a sequence that is a sequence of a SOD1 intron or a sequence complementary to a SOD1 intron.

Embodiment 59. The method of 56, wherein the targeting sequence of the gNA has a sequence that is a sequence of a SOD1 intron-exon junction or a sequence complementary to a SOD1 intron-exon junction.

Embodiment 60. The method of any one of 1-59, wherein the targeting sequence of the gNA has a sequence that hybridizes with one or more single nucleotide polymorphisms (SNPs) of the SOD1 gene and/or a SOD1 regulatory element.

Embodiment 61. The method of 56, wherein the targeting sequence of the gNA has a sequence that is a sequence of an intergenic region of the SOD1 gene or a sequence complementary to an intergenic region of the SOD1 gene.

Embodiment 62. The method of any one of 1 to 55, wherein the targeting sequence of the gNA is a sequence of a SOD1 regulatory element or a sequence that is complementary to a SOD1 regulatory element.

Embodiment 63. The method of 62, wherein the SOD1 regulatory element is 5' of the SOD1 gene.

Embodiment 64. The method of 62, wherein the SOD1 regulatory element is 3' of the SOD1 gene.

Embodiment 65. The method of 62, wherein the SOD1 regulatory element comprises the 5' UTR of the SOD1 gene.

Embodiment 66. The method of 62, wherein the SOD1 regulatory element comprises the 3'UTR of the SOD1 gene.

Embodiment 67. The method of 62, wherein the SOD1 regulatory element comprises a promoter.

Embodiment 68. The method of 62, wherein the SOD1 regulatory element comprises an enhancer.

Embodiment 69. The method of any one of 1 to 68, wherein the targeting sequence of the gNA has binding specificity for the SOD1 gene or the SOD1 regulatory element.

Embodiment 70. The method of any one of the preceding embodiments, wherein the method further comprises contacting the target nucleic acid with a donor template complementary to at least a portion of a SOD1 gene and/or a SOD1 regulatory element, wherein the SOD1 gene portion is selected from the group consisting of a SOD1 exon, a SOD1 intron, a SOD1 intron-exon junction, and wherein the SOD1 gene portion and/or a SOD1 regulatory element is inserted into or replaces the target nucleic acid comprising the one or more mutations.

Embodiment 71. The method of 70, wherein the donor template ranges in size from 10-10,000 nucleotides.

Embodiment 72. The method of 70, wherein the donor template ranges in size from 100-1,000 nucleotides.

Embodiment 73. The method of any one of 70-72, wherein the donor template is a single stranded DNA template or a single stranded RNA template.

Embodiment 74. The method of any one of 70-72, wherein the donor template is a double stranded DNA template.

Embodiment 75. The method of any one of 1 to 74, wherein the method comprises contacting the target nucleic acid with a pre-complexed CasX protein-gNA.

Embodiment 76. The method of 75, wherein the gNA comprises at least one nucleotide modification relative to a reference sequence selected from SEQ ID NOS: 1101-1105 of Table 2A, wherein the modification results in one or more improved characteristic in the method.

Embodiment 77. The method of 76, wherein the one or more improved characteristic comprises improved protein:gNA complex stability, improved protein:gNA complex stability, improved binding affinity between the protein and gNA, improved binding affinity to the target DNA, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, or improved resistance to nuclease activity.

Embodiment 78. The method of any one of 75-77, wherein the method comprises contacting a eukaryotic cell comprising the target nucleic acid with a liposome, a lipid nanoparticle, or a virus-like particle (VLP) comprising the CasX protein and the gNA.

Embodiment 79. The method of any one of 75-77, wherein the method comprises contacting a eukaryotic cell comprising the target nucleic acid with the one or more nucleic acids encoding the CasX protein and the gNA, and optionally the donor template.

Embodiment 80. The method of 79, wherein the nucleic acid encoding the CasX protein further comprises one or more nuclear localization signals (NLS).

Embodiment 81. The method of 80, wherein the one or more NLS are selected from the group of sequences consisting of PKKKRKV (SEQ ID NO: 145), KRPAATKK-AGQAKKKK (SEQ ID NO: 146), PAAKRVKLD (SEQ ID NO: 147), RQRRNELKRSP (SEQ ID NO: 148), NQSSNFGPMKGGNFGGRSSGPYGGGGQYFAK-PRNQGGY (SEQ ID NO: 149), RMRIZFKNKGKDTAEL-RRRRVEVSVELRKAKKDEQILKRRNV (SEQ ID NO: 150), VSRKRPRP (SEQ ID NO: 151), PPKKARED (SEQ ID NO: 152), PQPKKKPL (SEQ ID NO: 153), SALI AP (SEQ ID NO: 154), DRLRR (SEQ ID NO: 155), PKQKKRK (SEQ ID NO: 156), RKLKKKIKKL (SEQ ID NO: 157), REKKKFLKRR (SEQ ID NO: 158), KRKGDEVDGVDEVAKKKSKK (SEQ ID NO: 159), RKCLQAGMNLEARKTKK (SEQ ID NO: 160), PRPRKIPR (SEQ ID NO: 161), PPRKKRTVV (SEQ ID NO: 162), NLSKKKKRKREK (SEQ ID NO: 163), RRPSRPFRKP (SEQ ID NO: 164), KRPRSPSS (SEQ ID NO: 165), KRGINDRNFWRGENERKTR (SEQ ID NO: 166), PRPPKMARYDN (SEQ ID NO: 167), KRSFSKAF (SEQ ID NO: 168), KLKIKRPVK (SEQ ID NO: 169), PKTRRRPRRSQRKRPPT (SEQ ID NO: 171), RRKKRR-PRRKKRR (SEQ ID NO: 174), PKKKSRKPKKKSRK (SEQ ID NO: 175), HKKKHPDASVNFSEFSK (SEQ ID NO: 176), QRPGPYDRPQRPGPYDRP (SEQ ID NO: 177), LSPSLSPLLSPSLSPL (SEQ ID NO: 178), RGKGGKGLGKGGAKRHRK (SEQ ID NO: 179), PKR-GRGRPKRGRGR (SEQ ID NO: 180), and MSRRR-KANPTKLSENAKKLAKEVEN (SEQ ID NO: 205).

Embodiment 82. The method of 80 or 81, wherein the one or more NLS are expressed at the C-terminus of the CasX protein.

Embodiment 83. The method of 80 or 81, wherein the one or more NLS are expressed at the N-terminus of the CasX protein.

Embodiment 84. The method of 80 or 81, wherein the one or more NLS are expressed at the N-terminus and C-terminus of the CasX protein.

Embodiment 85. The method of any one of 79 to 84, wherein the one or more polynucleotides encoding the CasX protein are codon optimized for expression in a eukaryotic cell.

Embodiment 86. The method of any one of 79 to 85, wherein the method comprises contacting the eukaryotic cell with a vector encoding the CasX protein and the gNA, and optionally further encoding the donor template.

Embodiment 87. The method of 86, wherein the vector is an Adeno-Associated Viral (AAV) vector.

Embodiment 88. The method of 87, wherein the AAV is AAV1, AAV2, AAV3, AAV4, AAV5, AAV6, AAV7, AAV8, AAV9, AAV10, AAV-Rh74, or AAVRh10.

Embodiment 89. The method of 86, wherein the vector is a lentiviral vector.

Embodiment 90. The method of any one of 86-89, wherein the vector is administered to a subject at a therapeutically effective dose.

Embodiment 91. The method of 90, wherein the subject is selected from the group consisting of mouse, rat, non-human primate, and human.

Embodiment 92. The method of 91, wherein the subject is a human.

Embodiment 93. The method of any one of 90-92, wherein the vector is administered at a dose of at least about 1×10¹⁰ vector genomes (vg), or at least about 1×10¹¹ vg, or at least about 1×10¹² vg, or at least about 1×10¹³ vg, or at least about 1×10¹⁴ vg, or at least about 1×10¹⁵ vg, or at least about 1×10¹⁶ vg.

Embodiment 94. The method of any one of 90-93, wherein the vector is administered by a route of administration selected from the group consisting of intraparenchymal, intravenous, intra-arterial, intracerebroventricular, intracisternal, intrathecal, intracranial, and intraperitoneal routes.

Embodiment 95. The method of any one of the preceding embodiments, comprising further contacting the target nucleic acid with an additional CRISPR protein, or a polynucleotide encoding the additional CRISPR protein.

Embodiment 96. The method of 95, wherein the additional CRISPR protein is a CasX protein having a sequence different from the CasX of any of the preceding embodiments.

Embodiment 97. The method of 95, wherein the additional CRISPR protein is not a CasX protein.

Embodiment 98. The method of any one of 1 to 97, wherein the gNA is a single-molecule gNA (sgNA).

Embodiment 99. The method of any one of 1 to 97, wherein the gNA is a dual-molecule gNA (dgNA).

Embodiment 100. The method of any one of 1 to 99, comprising contacting the target nucleic acid with a plurality of gNAs targeted to the SOD1 gene and/or the SOD1 regulatory element having an allele with one or more mutations.

Embodiment 101. A cell comprising a modified SOD1 gene and/or a modified SOD1 regulatory element, wherein the modified SOD1 gene and/or the modified SOD1 regulatory element has been modified by either:

a) delivering to the cell a CasX protein and a guide nucleic acid (gNA) comprising a targeting sequence; or b) delivering to the cell one or more nucleic acids encoding a CasX protein and a gNA comprising a targeting sequence, wherein the targeting sequence of the gNA has binding specificity for the SOD1 gene and/or the SOD1 regulatory element.

Embodiment 102. The cell of 101, wherein the gNA is a guide RNA (gRNA).

Embodiment 103. The cell of 102, wherein the targeting sequence of the gNA comprises a sequence having at least about 65%, at least about 75%, at least about 85%, or at least about 95% identity to a sequence provided in Table 3.

Embodiment 104. The cell of 101 or 102, wherein the targeting sequence of the gNA comprises a sequence having one or more single nucleotide polymorphisms (SNP) relative to a sequence provided in Table 3.

Embodiment 105. The cell of 103 or 104, wherein the targeting sequence encodes a mutation of the SOD1 polypeptide of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T or mutations that disrupt the function or expression of the SOD1 polypeptide.

Embodiment 106. The method of any one of 101-105, wherein the CasX polypeptide and the gNA are associated together in a ribonuclear protein complex (RNP).

Embodiment 107. The cell of any one of 101-105, wherein the modified SOD1 gene and/or the SOD1 regulatory element comprises a single-stranded break, and wherein the modified SOD1 gene and/or the SOD1 regulatory element comprises a mutation, an insertion, or a deletion.

Embodiment 108. The cell of any one of 101-105, wherein the modified SOD1 gene and/or the SOD1 regulatory element comprises a double-stranded break, and wherein the modified SOD1 gene and/or the SOD1 regulatory element comprises a mutation, an insertion, or a deletion.

Embodiment 109. The cell of 106 or 108, wherein the insertion comprises a donor template comprising at least a portion of a SOD1 gene and/or the SOD1 regulatory element, and wherein the SOD1 gene portion is selected from the group consisting of a SOD1 exon, a SOD1 intron, and a SOD1 intron-exon junction.

Embodiment 110. The cell of 109, wherein the donor template ranges in size from 20-10,000 nucleotides.

Embodiment 111. The cell of 109 or 110, wherein the donor template is a single-stranded DNA template or a single stranded RNA template.

Embodiment 112. The method of 109 or 110, wherein the donor template is a double-stranded DNA template.

Embodiment 113. The cell of any one of 101-112, wherein modification of the SOD1 gene and/or the SOD1 regulatory element occurs in vivo.

Embodiment 114. The cell of any one of 101-112, wherein modification of the SOD1 gene and/or the SOD1 regulatory element occurs in vitro.

Embodiment 115. The cell of 113 or 114, wherein the modification corrects the one or more mutations, or wherein expression of the SOD1 having the one or more mutations is inhibited or suppressed.

Embodiment 116. The cell of any one of 101-115, wherein the cell is a eukaryotic cell.

Embodiment 117. The cell of 116, wherein the eukaryotic cell is selected from the group consisting of a plant cell, a fungal cell, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell.

Embodiment 118. The cell of 117, wherein the eukaryotic cell is a human cell.

Embodiment 119. The cell of 118, wherein the cell is a cell of the central nervous system (CNS) or peripheral nervous system (PNS).

Embodiment 120. The cell of 119, wherein the cell is a neuron.

Embodiment 121. The cell of 120, wherein the neuron is a spinal motor neuron.

Embodiment 122. The cell of 119, wherein the cell is a glial cell, an oligodendrocyte, or a Schwann cell.

Embodiment 123. The cell of any one of 101 to 122, wherein the SOD1 gene to be modified encodes a SOD1 polypeptide comprising one or more mutations selected from Table 1 or mutations that disrupt the function of the SOD1 polypeptide.

Embodiment 124. The cell of any one of 101 to 122, wherein the SOD1 gene or the SOD1 regulatory element comprises a wild type sequence.

Embodiment 125. The cell of any one of 101-122, wherein the one or more mutations is a gain of function mutation.

Embodiment 126. The cell of any one of 101-122, wherein the one or more mutations is a loss of function mutation.

Embodiment 127. The cell of any one of 101-122, wherein the SOD1 gene encodes a SOD1 polypeptide comprising a mutation at residue position 4, position 90, and/or residue position 93, corresponding to the SOD1 polypeptide of SEQ ID NO: 100.

Embodiment 128. The cell of 127, wherein the SOD1 gene encoding the SOD1 polypeptide comprises an A4V mutation, a D90A mutation, a G93A mutation, or a combination thereof.

Embodiment 129. A method of treating a SOD1 or related disorder in a subject in need thereof, comprising administering to the subject a plurality of cells of any one of the of 101-128.

Embodiment 130. The method of 129 wherein the SOD1-related disorder is amyotrophic lateral sclerosis (ALS).

Embodiment 131. The method of 129 wherein the SOD1-related disorder is a neuropathy.

Embodiment 132. The method of any one of 129 to 131, wherein the cells are allogeneic.

Embodiment 133. The method of any one of 129 to 131, wherein the cells are autologous.

Embodiment 134. The method of any one of 129 to 131, wherein the cells are part of a cell line.

Embodiment 135. The method of any one of 129 to 134, wherein the cells are administered by a route selected from the group consisting of intraparenchymal, intravenous, intra-arterial, intracerebroventricular, intracisternal, intrathecal, intracranial, and intraperitoneal routes.

Embodiment 136. A method of treating a SOD1 or related disorder in a subject in need thereof, comprising modifying a SOD1 gene and/or a SOD1 regulatory element having one or more mutations in a cell of the subject, the modifying comprising either;
a) administering to the subject a CasX protein and a guide nucleic acid (gNA) comprising a targeting sequence; or
b) administering to the subject one or more nucleic acids encoding a CasX protein and a gNA comprising a targeting sequence, wherein the targeting sequence of the gNA has a sequence complementary to the SOD1 gene and/or the SOD1 regulatory element having the one or more mutations.

Embodiment 137. The method of 136, wherein the targeting sequence of the gNA comprises a sequence having at least about 65%, at least about 75%, at least about 85%, or at least about 95% identity to a sequence provided in Table 3.

Embodiment 138. The method of 136 or 137, wherein the one or more nucleic acids encoding the CasX protein and the gNA are capable of being expressed in a cell.

Embodiment 139. The method of any one of 136-138, wherein the CasX polypeptide and the gNA are associated together in a ribonuclear protein complex (RNP).

Embodiment 140. The method of any one of 136-139, wherein the subject is selected from the group consisting of mouse, rat, non-human primate, and human.

Embodiment 141. The method of 136-140139, wherein the subject is a human.

Embodiment 142. The method of any one of 136-141, wherein the cell is a cell of the central nervous system (CNS) or peripheral nervous system (PNS).

Embodiment 143. The method of 142, wherein the cell is a neuron.

Embodiment 144. The method of 143, wherein the neuron is a spinal motor neuron.

Embodiment 145. The method of 144, wherein the cell is a glial cell, an oligodendrocyte, or a Schwann cell.

Embodiment 146. The method any one of 136 to 145, wherein the method comprises modifying an allele of the SOD1 gene and/or the SOD1 regulatory element in the cell.

Embodiment 147. The method of any one of 136 to 146, wherein the method comprises administering to the subject the CasX protein and gNA, or the one or more nucleic acids encoding the CasX protein and gNA, via an administration route selected from the group consisting of intraparenchymal, intravenous, intra-arterial, intracerebroventricular, intracisternal, intrathecal, intracranial, and intraperitoneal routes.

Embodiment 148. The method of any one of 136-147, wherein the CasX protein is selected from the CasX proteins provided in SEQ ID Nos: 1-3 or Table 4, or sequence proteins having at least about 50%, at least about 60%, at least about 70%, at least about 80%, or at least about 90%, or at least about 95%, or at least about 99% sequence identity to the CasX proteins of SEQ ID NOS:1-3 or the sequences of Table 4.

Embodiment 149. The method of any one of 136-148, wherein the CasX protein has binding affinity for a PAM sequence selected from the group consisting of TTC, ATC, GTC, and CTC.

Embodiment 150. The method of any one of 136-149, wherein the CasX protein comprises nickase activity.

Embodiment 151. The method of any one of 136-150, wherein the CasX protein introduces a single-stranded break in the target nucleic acid, and wherein modification of the SOD1 gene and/or the SOD1 regulatory element comprises a mutation, an insertion, or a deletion.

Embodiment 152. The method of any one of 136-149, wherein the CasX protein introduces a double-stranded break in the target nucleic acid, and wherein the modified SOD1 gene and/or the SOD1 regulatory element comprises a mutation, an insertion, or a deletion.

Embodiment 153. The method of any one of 136-152, wherein the modified SOD1 gene comprises an insertion.

Embodiment 154. The method of any one of 136-152, wherein the modified SOD1 gene comprises a deletion.

Embodiment 155. The method of any one of 136-149, wherein the CasX protein is a catalytically inactive CasX (dCasX) protein.

Embodiment 156. The method of 155, wherein the dCasX comprises a mutation at residues:
a) D672, E769, and/or D935 corresponding to the CasX protein of SEQ ID NO: 1; or
b) D659, E756 and/or D922 of SEQ ID NO: 2.

Embodiment 157. The method of 156, wherein the mutation is a substitution of alanine for the residue.

Embodiment 158. The method of any one of 136 to 157, wherein the SOD1 gene and/or the SOD1 regulatory element comprises a DNA sequence encoding a sequence having at least about 65%, at least about 75%, at least about 85%, or at least about 95% sequence identity to a sequence selected from Table 3.

Embodiment 159. The method of any one of 136-157, wherein the targeting sequence of the gNA comprises a sequence having one or more single nucleotide polymorphisms (SNP) relative to a sequence provided in Table 3.

Embodiment 160. The method of 158 or 159, wherein the targeting sequence encodes a mutation of the SOD1 polypeptide of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T, and mutations that disrupt the function or expression of the SOD1 polypeptide.

Embodiment 161. The method of any one of 136 to 157, wherein the SOD1 gene and/or the SOD1 regulatory element comprises a wild type sequence.

Embodiment 162. The method of any one of 136-160, wherein the mutation of the SOD1 gene and/or the SOD1 regulatory element is a gain of function mutation.

Embodiment 163. The method of any one of 136-160, wherein the mutation of the SOD1 gene and/or the SOD1 regulatory element is a loss of function mutation.

Embodiment 164. The method of any one of 136-160, wherein the SOD1 gene encodes a SOD1 polypeptide comprising a mutation selected from the mutations provided in Table 1 or mutations that disrupt the function of the SOD1 polypeptide.

Embodiment 165. The method of 164, wherein the SOD1 gene encodes a SOD1 polypeptide comprising an A4V mutation, a D90A mutation, and/or a G93A mutation of the sequence of SEQ ID NO:100.

Embodiment 166. The method of any one of 136-165, wherein the gNA is chemically modified.

Embodiment 167. The method of any one of 136-166, wherein the targeting sequence of the gNA has a sequence of a SOD1 exon or a sequence that is complementary to a SOD1 exon.

Embodiment 168. The method any one of 136-166, wherein the targeting sequence of the gNA has a sequence of a SOD1 intron or a sequence that is complementary to a SOD1 intron.

Embodiment 169. The method of any one of 136-166, wherein the targeting sequence of the gNA has a sequence of a SOD1 intron-exon junction or a sequence that is complementary to a SOD1 intron-exon junction.

Embodiment 170. The method any one of 136-166, wherein the targeting sequence of the gNA has a sequence with one or more single nucleotide polymorphisms of the SOD1 gene and/or SOD1 regulatory element, or a sequence that is complementary to one or more single nucleotide polymorphisms (SNP) of the SOD1 gene and/or SOD1 regulatory element.

Embodiment 171. The method of any one of 136-166, wherein the SOD1 gene and/or SOD1 regulatory element is a wild type sequence.

Embodiment 172. The method of any one of 136-171, wherein the targeting sequence of the gNA has a sequence that is complementary to an intergenic region of the SOD1 gene.

Embodiment 173. The method of any one of 136 to 166, wherein the targeting sequence of the gNA has a sequence that is complementary to a SOD1 regulatory element.

Embodiment 174. The method of 173, wherein the SOD1 regulatory element is 5' of the SOD1 gene.

Embodiment 175. The method of 173, wherein the SOD1 regulatory element is 3' of the SOD1 gene.

Embodiment 176. The method of 173, wherein the SOD1 regulatory element comprises the 5' untranslated region (UTR) of the SOD1 gene.

Embodiment 177. The method of 173, wherein the SOD1 regulatory element comprises the 3'UTR of the SOD1 gene.

Embodiment 178. The method of 173, wherein the SOD1 regulatory element comprises a promoter.

Embodiment 179. The method of 173, wherein the SOD1 regulatory element comprises an enhancer.

Embodiment 180. The method of any one of 136 to 179, wherein the targeting sequence of the gNA has a sequence that hybridizes with the SOD1 gene and/or the SOD1 regulatory element.

Embodiment 181. The method of any one of 136 to 180, wherein the modifying comprises introducing a single-stranded break in the target nucleic acid wherein modification of the SOD1 gene and/or the SOD1 regulatory element comprises a mutation, an insertion, or a deletion.

Embodiment 182. The method of any one of 136 to 180, wherein the modifying comprises introducing a double-stranded break in the target nucleic acid, wherein the modified SOD1 gene and/or the SOD1 regulatory element comprises a mutation, an insertion, or a deletion.

Embodiment 183. The method of any one of 136 to 182, wherein the method further comprises administering a donor template comprising at least a portion of a SOD1 gene, wherein the SOD-1 gene portion is selected from a SOD1 exon, a SOD1 intron, a SOD1 intron-exon junction, a SOD1 regulatory element, and wherein the SOD-1 gene portion is inserted into or replaces the target nucleic acid.

Embodiment 184. The method of 183, wherein the donor DNA template ranges in size from 10-10,000 nucleotides.

Embodiment 185. The method of 183 or 184, wherein the donor template is a single-stranded RNA or DNA template.

Embodiment 186. The method of 183 or 184, wherein the donor template is a double-stranded DNA template.

Embodiment 187. The method of any one of 136 to 186, wherein the SOD1 gene is a wild-type gene.

Embodiment 188. The method of any one of 136 to 187, wherein the method comprises contacting the target nucleic acid of the cell with a CasX protein and a gNA.

Embodiment 189. The method of 188, wherein the method comprises contacting the target nucleic acid of the cell with a pre-complexed CasX protein-gNA.

Embodiment 190. The method of 188, wherein the method comprises contacting the cell acid with a liposome or lipid nanoparticle comprising the CasX protein and the gNA.

Embodiment 191. The method of any one of 136 to 190, wherein the method comprises contacting the cell with the one or more nucleic acids encoding the CasX protein and the gNA, and optionally the donor template.

Embodiment 192. The method of 191, wherein the one or more nucleic encoding the CasX protein further comprise one or more nuclear localization signals (NLSs).

Embodiment 193. The method of 192, wherein the one or more NLS are selected from the sequences PKKKRKV (SEQ ID NO: 145), KRPAATKKAGQAKKKK (SEQ ID NO: 146), PAAKRVKLD (SEQ ID NO: 147), RQRR-NELKRSP (SEQ ID NO: 148), NQSSNFGPMKGGNFG-GRSSGPYGGGGQYFAKPRNQGGY (SEQ ID NO: 149), RMRIZFKNKGKDTAELRRRRVEVSVELRKAKKD-EQILKRRNV (SEQ ID NO: 150), VSRKRPRP (SEQ ID NO: 151), PPKKARED (SEQ ID NO: 152), PQPKKKPL (SEQ ID NO: 153), SALI AP (SEQ ID NO: 154), DRLRR (SEQ ID NO: 155), PKQKKRK (SEQ ID NO: 156), RKLKKKIKKL (SEQ ID NO: 157), REKKKFLKRR (SEQ ID NO: 158), KRKGDEVDGVDEVAKKKSKK (SEQ ID NO: 159), RKCLQAGMNLEARKTKK (SEQ ID NO: 160), PRPRKIPR (SEQ ID NO: 161), PPRKKRTVV (SEQ ID NO: 162), NLSKKKKRKREK (SEQ ID NO: 163), RRPSRPFRKP (SEQ ID NO: 164), KRPRSPSS (SEQ ID NO: 165), KRGINDRNFWRGENERKTR (SEQ ID NO: 166), PRPPKMARYDN (SEQ ID NO: 167), KRSFSKAF (SEQ ID NO: 168), KLKIKRPVK (SEQ ID NO: 169), PKTRRRPRRSQRKRPPT (SEQ ID NO: 171), RRKKRR-PRRKKRR (SEQ ID NO: 174), PKKKSRKPKKKSRK (SEQ ID NO: 175), HKKKHPDASVNFSEFSK (SEQ ID NO: 176), QRPGPYDRPQRPGPYDRP (SEQ ID NO: 177), LSPSLSPLLSPSLSPL (SEQ ID NO: 178), RGKGGKGLGKGGAKRHRK (SEQ ID NO: 179), PKR-GRGRPKRGRGR (SEQ ID NO: 180), and MSRRR-KANPTKLSENAKKLAKEVEN (SEQ ID NO: 205).

Embodiment 194. The method of 192, wherein the one or more NLSs are expressed at the C-terminus of the CasX protein.

Embodiment 195. The method of 192, wherein the one or more NLSs are expressed at the N-terminus of the CasX protein.

Embodiment 196. The method of 192, wherein the one or more NLSs are expressed at the N-terminus and C-terminus of the CasX protein.

Embodiment 197. The method of any one of 191 to 196, wherein the one or more nucleic acids encoding the CasX protein are codon optimized for expression in a eukaryotic cell.

Embodiment 198. The method of any one of 136 to 197, wherein the method comprises contacting the cell with a vector encoding the CasX protein and the gNA, the vector optionally further encoding the donor template.

Embodiment 199. The method of 198, wherein the vector is an AAV vector.

Embodiment 200. The vector of 199, wherein the AAV vector is selected from AAV1, AAV2, AAV3, AAV4, AAV5, AAV6, AAV7, AAV8, AAV9, AAV10, AAV-Rh74, or AAVRh10.

Embodiment 201. The method of 198, wherein the vector is a lentiviral vector.

Embodiment 202. The method of any one of 136 to 200, comprising further contacting the cell with an additional CRISPR protein, or a nucleic acid encoding the additional CRISPR protein.

Embodiment 203. The method of 202, wherein the additional CRISPR protein has a sequence different from the CasX protein of any of the preceding embodiments.

Embodiment 204. The method of 202, wherein the additional CRISPR protein is not a CasX protein.

Embodiment 205. The method of any one of 136 to 204, wherein the gNA is a single-molecule gNA (sgNA).

Embodiment 206. The method of any one of 136 to 204, wherein the gNA is a dual-molecule gNA (dgNA).

Embodiment 207. The method of any one of 136 to 206, comprising contacting the target nucleic acid with a plurality of gNAs targeted to the SOD1 gene and/or the SOD1 regulatory element.

Embodiment 208. The method of any one of 136 to 207, wherein the SOD1-related disorder is ALS.

Embodiment 209. The method of any one of 136 to 207, wherein the SOD1-related disorder is a neuropathy.

Embodiment 210. A CasX/gNA system comprising at least one CasX protein selected from those provided in SEQ ID NOs: 1-3 or Table 4 or sequences having at least about 50%, at least about 60%, at least about 70%, at least about 80%, or at least about 90%, or at least about 95%, or at least about 99% sequence identity to the CasX proteins of SEQ ID NOS:1-3 or Table 4 and at least one gRNA with a targeting sequence wherein the targeting sequence has a sequence that is complementary to a SOD1 gene and/or a SOD1 regulatory element, or polynucleotides encoding the same.

Embodiment 211. A CasX/gNA system comprising at least a CasX protein and at least one gNA with a targeting sequence wherein the targeting sequence has a sequence that is complementary to a SOD1 gene and/or a SOD1 regulatory element and wherein the targeting sequence of the gNA comprises a sequence having at least about 65%, at least about 75%, at least about 85%, or at least about 95% identity to a sequence provided in Table 3, or polynucleotides encoding the same.

Embodiment 212. The CasX/gNA system of 211, wherein the targeting sequence of the gNA comprises a sequence having one or more single nucleotide polymorphisms (SNP) relative to a sequence provided in Table 3.

Embodiment 213. The method of 211 or 212, wherein the targeting sequence encodes a mutation of the SOD1 polypeptide of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T, and mutations that disrupt the function or expression of the SOD1 polypeptide.

Embodiment 214. A CasX/gNA system comprising:
a) a CasX polypeptide and a gNA;
b) a CasX polypeptide, a gNA, and a donor template;
c) a CasX fusion polypeptide comprising a heterologous polypeptide and a gNA;
d) a CasX fusion polypeptide comprising a heterologous polypeptide, a gNA, and a donor template;
e) a vector comprising: i) a nucleotide sequence encoding a CasX polypeptide; and ii) a nucleotide sequence encoding a gNA;
f) a vector comprising: i) a nucleotide sequence encoding a CasX polypeptide; ii) a nucleotide sequence encoding a gNA; and iii) a donor template;
g) a vector comprising: i) a nucleotide sequence encoding a CasX fusion polypeptide comprising a heterologous polypeptide; and ii) a nucleotide sequence encoding a gNA; or
h) a vector comprising: i) a nucleotide sequence encoding a CasX fusion polypeptide comprising a heterologous polypeptide; ii) a nucleotide sequence encoding a gNA; and a donor template.

Embodiment 215. The system of 214, wherein the CasX protein is selected from those provided in SEQ ID NOS: 1-3 or Table 4 or sequences having at least about 50%, at least about 60%, at least about 70%, at least about 80%, or at least about 90%, or at least about 95%, or at least about 99% sequence identity to the CasX proteins of SEQ ID NOS:1-3 or Table 4 and the gRNA targeting sequence has a sequence that is complementary to a SOD1 gene and/or a SOD1 regulatory element.

Embodiment 216. The system of 214 or 215, wherein the CasX polypeptide and the gNA are associated together in a ribonuclear protein complex (RNP).

Embodiment 217. The system of any one of 214-216, wherein the donor template comprises at least a portion of a SOD1 gene, wherein the SOD1 gene portion is selected from the group consisting of a SOD1 exon, a SOD1 intron, a SOD1 intron-exon junction, and a SOD1 regulatory element.

Embodiment 218. The system of any one of 214-216, wherein the donor template is a single stranded DNA template or a single stranded RNA template.

Embodiment 219. The method of any one of 214-216, wherein the donor template is a double stranded DNA template.

Embodiment 220. The system of any one of 214-219, wherein the heterologous polypeptide inhibits transcription, modifies a target nucleic acid, or modifies a polypeptide associated with a nucleic acid.

Embodiment 221. The system of any one of 214-220, wherein vector is an Adeno-Associated Viral (AAV) vector.

Embodiment 222. The system of 221, wherein the AAV is AV1, AAV2, AAV3, AAV4, AAV5, AAV6, AAV7, AAV8, AAV9, AAV10, AAV-Rh74, or AAVRh10.

Embodiment 223. A polynucleotide encoding a gNA comprising a targeting sequence, wherein the targeting sequence has a sequence that is complementary to a SOD1 gene and/or a SOD1 regulatory element, wherein the gNA is capable of binding to a CasX protein.

Embodiment 224. A polynucleotide encoding a gNA targeting sequence, wherein the targeting sequence of the gNA comprises a sequence having at least about 65%, at least about 75%, at least about 85%, or at least about 95% identity to a sequence provided in Table 3.

Embodiment 225. The polynucleotide of 224, wherein the targeting sequence of the gNA comprises a sequence having one or more single nucleotide polymorphisms (SNP) relative to a sequence provided in Table 3.

Embodiment 226. The polynucleotide of 224 or 225, wherein the targeting sequence encodes a mutation of the SOD1 polypeptide of SEQ ID NO:100 selected from the group consisting of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T and mutations that disrupt the function or expression of the SOD1 polypeptide.

Embodiment 227. The polynucleotide of 223 or 224, wherein the polynucleotide further encodes a CasX protein.

Embodiment 228. The polynucleotide of any one of 223-227, wherein the polynucleotide is a DNA.

Embodiment 229. A vector comprising any of the polynucleotides of 223-228.

Embodiment 230. The vector of 229, wherein the vector is a viral vector.

Embodiment 231. The vector of 229, wherein the vector is a lentiviral vector.

Embodiment 232. The vector of 229, wherein the vector is an AAV vector.

Embodiment 233. The vector of 232, wherein the AAV vector is AV1, AAV2, AAV3, AAV4, AAV5, AAV6, AAV7, AAV8, AAV9, AAV10, AAV-Rh74, or AAVRh10.

Embodiment 234. A cell comprising the polynucleotide or vector of any one of 223-233.

Set 2

Embodiment 1. A CasX:gNA system comprising a CasX protein and a guide nucleic acid (gNA), wherein the gNA comprises a targeting sequence complementary to a target nucleic acid sequence comprising a superoxide dismutase 1 (SOD1) gene.

Embodiment 2. The CasX:gNA system of 1, wherein the SOD1 gene comprises one or more mutations in the sequence of the SOD1 gene encoding the SOD1 protein.

Embodiment 3. The CasX:gNA system of 1 or 2, wherein the SOD1 gene comprises one or more mutations in the sequence of the SOD1 gene encoding the regulatory region.

Embodiment 4. The CasX:gNA system of 1, wherein the SOD1 gene comprises a wild-type sequence in the sequence encoding the SOD1 protein or the regulatory region.

Embodiment 5. The CasX:gNA system of 4, wherein the wild-type sequence comprises a nucleic acid encoding all or a portion of SEQ ID NO:100, or comprises a nucleic acid sequence that spans all or a portion of bp 31,659,622 to bp 31,668,931 of chromosome 21 of human genome GRCh38/hg38.

Embodiment 6. The CasX:gNA system of 2 or 3, wherein the mutation is an insertion, deletion, substitution, duplication, or inversion of one or more nucleotides as compared to the wild-type sequence.

Embodiment 7. The CasX:gNA system of any one of 2, 3, or 6, wherein the mutation is a gain of function mutation.

Embodiment 8. The CasX:gNA system of any one of 2, 3, or 6, wherein the mutation is a loss of function mutation.

Embodiment 9. The CasX:gNA system of any one of 2, 3, or 6-8, wherein the SOD1 gene encodes a protein comprising a mutation selected from mutations set forth in Table 1 or comprises one or more mutations that disrupt the function of the SOD1 protein.

Embodiment 10. The CasX:gNA system any one of 2, 3, or 6-9, wherein the SOD1 gene encodes a protein comprising a mutation selected from the group of amino acid substitutions of SEQ ID NO:100 consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T and one or more amino acid substitutions of SEQ ID NO:100 that disrupt a function or expression of the SOD1 protein, or is selected from a combination thereof.

Embodiment 11. The CasX:gNA system of 10, wherein the SOD1 gene encodes a protein comprising a mutation selected from an A4V mutation of SEQ ID NO:100, a D90A mutation of SEQ ID NO:100, a G93A mutation of SEQ ID NO:100, or a combination thereof.

Embodiment 12. The CasX:gNA system of any one 1-11, wherein the gNA is a guide RNA (gRNA).

Embodiment 13. The CasX:gNA system of any one of 1-11, wherein the gNA is a guide DNA (gDNA).

Embodiment 14. The CasX:gNA system of any one of 1-11, wherein the gNA is a chimera comprising DNA and RNA.

Embodiment 15. The CasX:gNA system of any one 1-14, wherein the gNA is a single-molecule gNA (sgNA).

Embodiment 16. The CasX:gNA system of any one of 1-14, wherein the gNA is a dual-molecule gNA (dgNA).

Embodiment 17. The CasX:gNA system of any one 1-16, wherein the targeting sequence of the gNA comprises a sequence selected from the group consisting of the sequences set forth in Table 3.

Embodiment 18. The CasX:gNA system of any one of 1-16, wherein the targeting sequence of the gNA comprises a sequence a sequence of Table 3 with a single nucleotide removed from the 3' end of the sequence.

Embodiment 19. The CasX:gNA system of any one of 1-16, wherein the targeting sequence of the gNA comprises a sequence a sequence of Table 3 with two nucleotides removed from the 3' end of the sequence.

Embodiment 20. The CasX:gNA system of any one of 1-16, wherein the targeting sequence of the gNA comprises a sequence a sequence of Table 3 with three nucleotides removed from the 3' end of the sequence.

Embodiment 21. The CasX:gNA system of any one of 1-16, wherein the targeting sequence of the gNA comprises a sequence a sequence of Table 3 with four nucleotides removed from the 3' end of the sequence.

Embodiment 22. The CasX:gNA system of any one of 1-16, wherein the targeting sequence of the gNA comprises a sequence a sequence of Table 3 with five nucleotides removed from the 3' end of the sequence.

Embodiment 23. The CasX:gNA system of any one of 1-22, wherein the targeting sequence of the gNA is complementary to a sequence of a SOD1 exon or a sequence complementary to a SOD1 exon.

Embodiment 24. The CasX:gNA system of any one of 1-22, wherein the targeting sequence of the gNA is complementary to a sequence of a SOD1 intron or a sequence complementary to a SOD1 intron.

Embodiment 25. The CasX:gNA system of any one of 1-22, wherein the targeting sequence of the gNA is complementary to a sequence of a SOD1 intron-exon junction or a sequence complementary to a SOD1 intron-exon junction.

Embodiment 26. The CasX:gNA system of any one of 1-22, wherein the targeting sequence of the gNA is complementary to a sequence comprising one or more single nucleotide polymorphisms (SNPs) of the SOD1 gene.

Embodiment 27. The CasX:gNA system of any one of 1-22, wherein the targeting sequence of the gNA is complementary to a sequence of an intergenic region of the SOD1 gene.

Embodiment 28. The CasX:gNA system of any one of 1-22, wherein the targeting sequence of the gNA comprises a DNA sequence having at least about 65%, at least about 75%, at least about 85%, or at least about 95% identity to a sequence selected from the group consisting of sequences set forth in Table 3.

Embodiment 29. The CasX:gNA system of any one of 1-22, wherein the targeting sequence of the gNA comprises a DNA sequence having one or more single nucleotide polymorphisms (SNP) relative to a sequence set forth in Table 3.

Embodiment 30. The CasX:gNA system of any one of 1-17, wherein the targeting sequence of the gNA consists of a sequence selected from the group consisting of sequences set forth in Table 3.

Embodiment 31. The CasX:gNA system of any one of 1-16, wherein the targeting sequence is complementary to a nucleic acid sequence encoding a mutation of the SOD1 protein of SEQ ID NO:100 selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T, and one or more amino acid substitutions of SEQ ID NO:100 that disrupt the function or expression of the SOD1 protein.

Embodiment 32. The CasX:gNA system of any one of 1-31, further comprising a second gNA, wherein the second gNA has a targeting sequence complementary a different or overlapping portion of the target nucleic acid compared to the targeting sequence of the gNA of any one of the preceding.

Embodiment 33. The CasX:gNA system of any one of 1-32, wherein the gNA has a scaffold comprising a sequence having at least about 50%, at least about 60%, at least about 70%, at least about 80%, at least about 90%, at least about 95%, at least about 96%, at least about 97%, at least about 98%, at least about 99%, or 100% sequence identity to a sequence selected from the group consisting of sequences set forth in Table 2A or 2B.

Embodiment 34. The CasX:gNA system of 33, wherein the gNA scaffold comprises a sequence having at least one modification relative to a reference gNA sequence selected from the group consisting of SEQ ID NOS: 4-16 of Table 2A.

Embodiment 35. The CasX:gNA system of 34, wherein the at least one modification of the reference gNA comprises at least one substitution, deletion, or substitution of a nucleotide of the gNA sequence.

Embodiment 36. The CasX:gNA system of any one of 1-35, wherein the gNA is chemically modified.

Embodiment 37. The CasX:gNA system of any one of 1-36, wherein the CasX protein comprises a reference CasX protein having a sequence of any one of SEQ ID NOS: 1-3 or a CasX variant protein having a sequence of Table 4, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto.

Embodiment 38. The CasX:gNA system of 37, wherein the CasX protein has binding affinity for a protospacer adjacent motif (PAM) sequence selected from the group consisting of TTC, ATC, GTC, and CTC.

Embodiment 39. The CasX:gNA system of 37 or 38, wherein the CasX variant protein comprises at least one modification relative to a reference CasX protein having a sequence selected from SEQ ID NOS:1-3.

Embodiment 40. The CasX:gNA system of 39, wherein the at least one modification comprises at least one amino acid substitution, deletion, or substitution in a domain of the CasX variant protein relative to the reference CasX protein.

Embodiment 41. The CasX:gNA system of 40, wherein the domain is selected from the group consisting of a non-target strand binding (NTSB) domain, a target strand loading (TSL) domain, a helical I domain, a helical II domain, an oligonucleotide binding domain (OBD), and a RuvC DNA cleavage domain.

Embodiment 42. The CasX:gNA system of any one of 37-41, wherein the CasX protein further comprises one or more nuclear localization signals (NLS).

Embodiment 43. The CasX:gNA system of 42, wherein the one or more NLS are selected from the sequences PKKKRKV (SEQ ID NO: 145), KRPAATKKAGQAKKKK (SEQ ID NO: 146), PAAKRVKLD (SEQ ID NO: 147), RQRRNELKRSP (SEQ ID NO: 148), NQSSNFGPMKGG-NFGGRSSGPYGGGGQYFAKPRNQGGY (SEQ ID NO: 149), RMRIZFKNKGKDTAELRRRRVEVS-VELRKAKKDEQILKRRNV (SEQ ID NO: 150), VSRKR-PRP (SEQ ID NO: 151), PPKKARED (SEQ ID NO: 152), PQPKKKPL (SEQ ID NO: 153), SALI AP (SEQ ID NO: 154), DRLRR (SEQ ID NO: 155), PKQKKRK (SEQ ID NO: 156), RKLKKKIKKL (SEQ ID NO: 157), REKKKFLKRR (SEQ ID NO: 158), KRKGDEVDGVDE-VAKKKSKK (SEQ ID NO: 159), RKCLQAGMNLEAR-KTKK (SEQ ID NO: 160), PRPRKIPR (SEQ ID NO: 161), PPRKKRTVV (SEQ ID NO: 162), NLSKKKKRKREK (SEQ ID NO: 163), RRPSRPFRKP (SEQ ID NO: 164), KRPRSPSS (SEQ ID NO: 165), KRGINDRNFWR-GENERKTR (SEQ ID NO: 166), PRPPKMARYDN (SEQ ID NO: 167), KRSFSKAF (SEQ ID NO: 168), KLKIKRPVK (SEQ ID NO: 169), PKTRRRPRR-SQRKRPPT (SEQ ID NO: 171), RRKKRRPRRKKRR (SEQ ID NO: 174), PKKKSRKPKKKSRK (SEQ ID NO: 175), HKKKHPDASVNFSEFSK (SEQ ID NO: 176), QRPGPYDRPQRPGPYDRP (SEQ ID NO: 177), LSPSL-SPLLSPSLSPL (SEQ ID NO: 178), RGKGGKGLGKG-GAKRHRK (SEQ ID NO: 179), PKRGRGRPKRGRGR (SEQ ID NO: 180), and MSRRR-KANPTKLSENAKKLAKEVEN (SEQ ID NO: 205).

Embodiment 44. The CasX:gNA system of 42 or 43, wherein the one or more NLS are expressed at the C-terminus of the CasX protein.

Embodiment 45. The CasX:gNA system of 42 or 43, wherein the one or more NLS are expressed at the N-terminus of the CasX protein.

Embodiment 46. The CasX:gNA system of 42 or 43, wherein the one or more NLS are expressed at the N-terminus and C-terminus of the CasX protein.

Embodiment 47. The CasX:gNA system of any one of 37-46, wherein the CasX variant protein exhibits at least one or more improved characteristics as compared to corresponding characteristics of a reference CasX protein.

Embodiment 48. The CasX:gNA system of 47, wherein the improved characteristic is selected from the group consisting of improved folding of the CasX protein, improved binding affinity of the CasX protein to the guide RNA, improved ribonuclear protein complex (RNP) formation, higher percentage of cleavage-competent RNP, improved binding affinity to the target nucleic acid, altered binding affinity to one or more PAM sequences, improved unwinding of the target nucleic acid, increased activity, increased target nucleic acid cleavage rate, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved CasX protein stability, improved protein:guide RNA complex stability, improved protein solubility, improved protein:guide RNA complex solubility, improved protein yield, improved protein expression, and improved fusion characteristics.

Embodiment 49. The CasX:gNA system of 47 or 48, wherein the improved characteristic of the CasX variant protein is at least about 1.1 to about 100,000-fold improved relative to the characteristic of the reference CasX protein of SEQ ID NO: 1, SEQ ID NO: 2, or SEQ ID NO: 3.

Embodiment 50. The CasX:gNA system of 47 or 48, wherein the improved characteristic of the CasX variant protein is at least about 10-fold, at least about 100-fold, at least about 1,000-fold, or at least about 10,000-fold improved relative to the characteristics of the reference CasX protein of SEQ ID NO: 1, SEQ ID NO: 2, or SEQ ID NO: 3.

Embodiment 51. The CasX:gNA system of any one of 48-50, wherein the improved characteristic is improved binding affinity to the target nucleic acid.

Embodiment 52. The CasX:gNA system of any one of 48-50, wherein the improved characteristic is increased target nucleic acid cleavage rate.

Embodiment 53. The CasX:gNA system of any one of 48-50, wherein the improved characteristic is increased binding affinity to one or more PAM sequences wherein the one or more PAM sequences are selected from the group consisting of TTC, ATC, GTC, and CTC.

Embodiment 54. The CasX:gNA system of any one of 1-53, wherein the CasX protein and the gNA are associated together in an RNP.

Embodiment 55. The CasX:gNA system of 54, wherein the RNP comprising a CasX variant has a higher percentage of cleavage-competent RNP compared to an RNP of a reference CasX protein of SEQ ID NO: 1, SEQ ID NO: 2, or SEQ ID NO: 3 and the gNA.

Embodiment 56. The CasX:gNA system of any one of 41-55, wherein the CasX variant protein comprises a RuvC DNA cleavage domain having nickase activity.

Embodiment 57. The CasX:gNA system of any one of 41-55, wherein the CasX variant protein comprises a RuvC DNA cleavage domain having double-stranded cleavage activity.

Embodiment 58. The CasX:gNA system of any one of 1-46, wherein the CasX protein is a catalytically inactive CasX (dCasX) protein, and wherein the dCasX and the gNA retain the ability to bind to the target nucleic acid.

Embodiment 59. The CasX:gNA system of 58, wherein the dCasX comprises a mutation at residues:
 a. D672, E769, and/or D935 corresponding to the CasX protein of SEQ ID NO:1; or
 b. D659, E756 and/or D922 corresponding to the CasX protein of SEQ ID NO: 2.

Embodiment 60. The CasX:gNA system of 59, wherein the mutation is a substitution of alanine for the residue.

Embodiment 61. The CasX:gNA system of any one of 1-60, further comprising a donor template nucleic acid.

Embodiment 62. The CasX:gNA system of 61, wherein the donor template comprises a nucleic acid comprising at least a portion of a SOD1 gene coding the SOD1 protein or the SOD1 regulatory region, selected from the group consisting of a SOD1 exon, a SOD1 intron, and a SOD1 intron-exon junction.

Embodiment 63. The CasX:gNA system of 61 or 62, wherein the donor template ranges in size from 10-10,000 nucleotides.

Embodiment 64. The CasX:gNA system of any one of 61-63, wherein the donor template is a single-stranded DNA template or a single stranded RNA template.

Embodiment 65. The CasX:gNA system of any one of 61-63, wherein the donor template is a double-stranded DNA template.

Embodiment 66. A nucleic acid comprising a sequence that encodes the CasX:gNA system of any one of 1-65.

Embodiment 67. The nucleic acid of 66, wherein the nucleic acids encoding the CasX protein and gNA are codon optimized for expression in a eukaryotic cell.

Embodiment 68. A vector comprising the nucleic acid of 66 or 67.

Embodiment 69. A vector comprising a donor template, wherein the donor template comprises a nucleic acid comprising at least a portion of a SOD1 gene encoding the SOD1 protein or the SOD1 regulatory region Embodiment 70. The vector of 69, further comprising the nucleic acid of 66 or 67.

Embodiment 71. The vector of any one of 68-70, wherein the vector further comprises a promoter.

Embodiment 72. The vector of any one of 68-70, wherein the vector is selected from the group consisting of a retroviral vector, a lentiviral vector, an adenoviral vector, an adeno-associated viral (AAV) vector, a herpes simplex virus (HSV) vector, a virus-like particle (VLP), a plasmid, a minicircle, a nanoplasmid, and an RNA vector.

Embodiment 73. The vector of 72, wherein the vector is an AAV vector.

Embodiment 74. The vector of 73, wherein the AAV vector is selected from AAV1, AAV2, AAV3, AAV4, AAV5, AAV6, AAV7, AAV8, AAV9, AAV10, AAV-Rh74, or AAVRh10.

Embodiment 75. The vector of 72, wherein the vector is a retroviral vector.

Embodiment 76. The vector of 72, wherein the vector encoding the VLP comprises one or more nucleic acids encoding a gag polyprotein, the CasX protein of any one of 37-57, and the gNA of any one of 1-36.

Embodiment 77. A virus-like particle (VLP) comprising the CasX protein of any one of 37-57, and the gNA of any one of 1-36.

Embodiment 78. The VLP of 77, wherein the CasX protein and the gNA are associated together in an RNP.

Embodiment 79. A method of modifying a SOD1 target nucleic acid, optionally comprising one or more mutations, the method comprising contacting the target nucleic acid with a CasX protein and a guide nucleic acid (gNA) comprising a targeting sequence wherein said contacting comprises introducing into a cell:

a. (i) the CasX protein of any one of 37-57 or a nucleic acid encoding the CasX protein; and (ii) the gNA of any one of 1-36, or a nucleic acid encoding the gNA; or b. the CasX:gNA system of any one of 1-65, or a nucleic acid encoding the system, wherein said contacting results in modification of the target nucleic acid by the CasX protein.

Embodiment 80. The method of 79, wherein the CasX protein and the gNA are associated together in a ribonuclear protein complex (RNP).

Embodiment 81. The method of 79 or 80, further comprising a second gNA or a nucleic acid encoding the second gNA, wherein the second gNA has a targeting sequence complementary to a different or overlapping portion of the target nucleic acid.

Embodiment 82. The method of any one of 79-81, wherein the method comprises modifying the target nucleic acid of the SOD1 gene coding the SOD1 protein or the SOD1 regulatory region.

Embodiment 83. The method of any one of 79-82, further comprising contacting the target nucleic acid with a donor template comprising at least a portion of a SOD1 gene coding the SOD1 protein or the SOD1 regulatory region.

Embodiment 84. The method of any one of 79-83, wherein the modifying comprises introducing a single-stranded break in the target nucleic acid.

Embodiment 85. The method of any one of 79-85, wherein the modifying comprises introducing a double-stranded break in the target nucleic acid.

Embodiment 86. The method of 84 or 85, wherein the modifying results in an insertion, deletion, substitution, duplication, or inversion of one or more nucleotides as compared to the wild-type sequence.

Embodiment 87. The method of any one of 79-86, wherein the mutation is a gain of function mutation.

Embodiment 88. The method of any one of 79-86, wherein the mutation is a loss of function mutation.

Embodiment 89. The method of any one of 79-86, wherein the mutation of the SOD1 gene encodes an amino acid substitution selected from the group of mutations set forth in Table 1 or comprises one or more mutations that disrupt the function of the SOD1 protein.

Embodiment 90. The method of any one of 79-86, wherein the mutation of the SOD1 gene encodes an amino acid substitution selected from the group of amino acid substitutions consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148I, I149T, I151T of SEQ ID NO:100 and one or more amino acid substitutions that disrupt a function or expression of the SOD1 protein.

Embodiment 91. The method of 90, wherein the mutation of the SOD1 gene encodes an amino acid substitution selected from an A4V mutation of SEQ ID NO:100, a D90A mutation of SEQ ID NO:100, a G93A mutation of SEQ ID NO:100, or a combination thereof.

Embodiment 92. The method of any one of 76-91, wherein the modifying of the target nucleic acid occurs inside of a cell.

Embodiment 93. The method of 92, wherein the modifying of the target nucleic acid occurs in vivo.

Embodiment 94. The method of 92, wherein the modifying of the target nucleic acid occurs in vitro.

Embodiment 95. The method of any one of 76-94, wherein the cell is a eukaryotic cell.

Embodiment 96. The method of 95, wherein the eukaryotic cell is selected from the group consisting of a rodent cell, a mouse cell, a rat cell, a primate cell, a non-human primate cell, and a human cell.

Embodiment 97. The method of 96, wherein the eukaryotic cell is a human cell.

Embodiment 98. The method of any one of 76-97, wherein the cell is a cell of a central nervous system (CNS) or a peripheral nervous system (PNS).

Embodiment 99. The method of 98, wherein the cell is a neuron.

Embodiment 100. The method of 99, wherein the neuron is a spinal motor neuron.

Embodiment 101. The method of 98, wherein the cell is a glial cell, an oligodendrocyte, or a Schwann cell.

Embodiment 102. The method of any one of 79-101, wherein the method further comprises contacting the target nucleic acid with a donor template complementary to at least a portion of a SOD1 gene, wherein the donor template is inserted into the target nucleic acid to correct the one or more mutations or is inserted to replace the target nucleic acid.

Embodiment 103. The method of 102, wherein the donor template ranges in size from 10-10,000 nucleotides.

Embodiment 104. The method of 102, wherein the donor template ranges in size from 100-1,000 nucleotides.

Embodiment 105. The method of any one of 102-104, wherein the donor template is a single-stranded DNA template or a single stranded RNA template.

Embodiment 106. The method of any one of 102-104, wherein the donor template is a double-stranded DNA template.

Embodiment 107. The method of any one of 102-106, wherein the donor template is inserted by homology directed repair (HDR).

Embodiment 108. The method of any one of 95-107, wherein the method comprises contacting the eukaryotic cell with a vector encoding or comprising the CasX protein and the gNA, and optionally further comprising the donor template.

Embodiment 109. The method of 108, wherein the vector is an Adeno-Associated Viral (AAV) vector.

Embodiment 110. The method of 109, wherein the AAV is AAV1, AAV2, AAV3, AAV4, AAV5, AAV6, AAV7, AAV8, AAV9, AAV10, AAV-Rh74, or AAVRh10.

Embodiment 111. The method of 108, wherein the vector is a retroviral vector.

Embodiment 112. The method of any one of 95-108, wherein the method comprises contacting the eukaryotic cell with a VLP vector, wherein the VLP vector comprises the RNP of 54.

Embodiment 113. The method of any one of 108-112, wherein the vector is administered to a subject at a therapeutically effective dose.

Embodiment 114. The method of 113, wherein the subject is selected from the group consisting of mouse, rat, non-human primate, and human.

Embodiment 115. The method of 114, wherein the subject is a human.

Embodiment 116. The method of any one of 113-115, wherein the vector is administered at a dose of at least about $1\times10^{10}$ vector genomes (vg), or at least about $1\times10^{11}$ vg, or at least about $1\times10^{12}$ vg, or at least about $1\times10^{13}$ vg, or at least about $1\times10^{14}$ vg, or at least about $1\times10^{15}$ vg, or at least about $1\times10^{16}$ vg.

Embodiment 117. The method of any one of 113-116, wherein the vector is administered by a route of administration selected from the group consisting of intraparenchymal, intravenous, intra-arterial, intracerebroventricular, intracisternal, intrathecal, intracranial, lumbar, and intraperitoneal routes.

Embodiment 118. The method of any one of 79-117, comprising further contacting the target nucleic acid with an additional CRISPR protein, or a polynucleotide encoding the additional CRISPR protein.

Embodiment 119. The method of 118, wherein the additional CRISPR protein is a CasX protein having a sequence different from the CasX of any of the preceding.

Embodiment 120. The method of 118, wherein the additional CRISPR protein is not a CasX protein.

Embodiment 121. A method of altering a SOD1 target nucleic acid of a cell, comprising contacting said cell with: a) CasX:gNA system of any one of 1-65; b) the nucleic acid of 66 or 67; c) the vector as in any one of 68-76; d) the VLP of 77 or 78; or e) a combination thereof.

Embodiment 122. The method of 121, wherein the cell has been modified such that expression of the SOD1 protein is reduced by at least about 50%, at least about 60%, at least about 70%, at least about 80%, at least about 90%, or at least about 95% in comparison to a cell that has not been modified.

Embodiment 123. The method of 121 or 122, wherein the cell has been modified such that the cell does not express a detectable level of the SOD1 protein.

Embodiment 124. The method of 121, wherein the cell has been modified such that it expresses SOD1 protein having the sequence of SEQ ID NO:100.

Embodiment 125. A population of cells modified by the method of 121 or 122, wherein the cells have been modified such that at least 70%, at least 75%, at least 80%, at least 85%, at least 90%, or at least 95% of the modified cells do not express a detectable level of SOD1 protein.

Embodiment 126. A population of cells modified by the method of 124, wherein the cells have been modified such that at least 70%, at least 75%, at least 80%, at least 85%, at least 90%, or at least 95% of the modified cells express a detectable level of SOD1 protein having the sequence of SEQ ID NO:100.

Embodiment 127. The population of cells of 125 or 126, wherein the cell is a non-primate mammalian cell, a non-human primate cell, or a human cell.

Embodiment 128. The population of cells of any one of 125-127, wherein the cell is selected from the group consisting of a neuron, a spinal motor neuron, a glial cell, an oligodendrocyte, or a Schwann cell.

Embodiment 129. The population of cells of any one of 125-128, wherein the cells are autologous with respect to a subject to be administered the cell.

Embodiment 130. The population of cells of any one of 125-128, wherein the cells are allogeneic with respect to a subject to be administered the cell.

Embodiment 131. A population of cells, comprising the CasX:gNA system of any one of 1-65.

Embodiment 132. A method of treating a SOD1 or related disorder in a subject in need thereof, the method comprising administering to the subject an effective amount of the cells of any one of 125-131.

Embodiment 133. The method of 132, wherein the method further comprises administering a chemotherapeutic agent.

Embodiment 134. A method of treating a SOD1 disorder in a subject in need thereof, comprising modifying a SOD1 gene having one or more mutations in a cell of the subject, the modifying comprising contacting said cell with:
 a. CasX:gNA system of any one of 1-65;
 b. the nucleic acid of 66 or 67;
 c. the vector as in any one of 68-75;
 d. the VLP of 77 or 78; or
 e. a combination thereof.

Embodiment 135. The method of 134, further comprising a second gNA or a nucleic acid encoding the second gNA, wherein the second gNA has a targeting sequence complementary to a different or overlapping portion of the target nucleic acid.

Embodiment 136. The method of 134 or 135, wherein the modifying corrects the one or more mutations, or wherein expression of the SOD1 having the one or more mutations is inhibited or suppressed.

Embodiment 137. The method of any one of 134-136, wherein the method comprises contacting the cell with a vector encoding the CasX protein and the gNA, and optionally further comprising the donor template.

Embodiment 138. The method of 137, wherein the vector is an Adeno-Associated Viral (AAV) vector.

Embodiment 139. The method of 138, wherein the AAV is AAV1, AAV2, AAV3, AAV4, AAV5, AAV6, AAV7, AAV8, AAV9, AAV10, AAV-Rh74, or AAVRh10.

Embodiment 140. The method of 137, wherein the vector is a retroviral vector.

Embodiment 141. The method of any one of 134-140, wherein the vector is administered to a subject at a therapeutically effective dose.

Embodiment 142. The method of 141, wherein the subject is selected from the group consisting of mouse, rat, non-human primate, and human.

Embodiment 143. The method of 142, wherein the subject is a human.

Embodiment 144. The method of any one of 137-143, wherein the vector is administered to the subject at a dose of at least about $1\times10^{10}$ vector genomes (vg), or at least about $1\times10^{11}$ vg, or at least about $1\times10^{12}$ vg, or at least about $1\times10^{13}$ vg, or at least about $1\times10^{14}$ vg, or at least about $1\times10^{15}$ vg, or at least about $1\times10^{16}$ vg.

Embodiment 145. The method of any one of 137-144, wherein the vector is administered by a route of administration selected from the group consisting of intraparenchymal, intravenous, intra-arterial, intracerebroventricular, intracisternal, intrathecal, intracranial, lumbar, and intraperitoneal routes.

Embodiment 146. The method of any one of 137-145, comprising further contacting the target nucleic acid with an additional CRISPR protein, or a polynucleotide encoding the additional CRISPR protein.

Embodiment 147. The method of 146, wherein the additional CRISPR protein is a CasX protein having a sequence different from the CasX of any of the preceding.

Embodiment 148. The method of 147, wherein the additional CRISPR protein is not a CasX protein.

Embodiment 149. The method of any one of 134-148, wherein the method results in improvement in at least one clinically-relevant endpoint selected from the group consisting of ALS Functional Rating Scale (ALSFRS-(R)), combined assessment of function and survival, duration of response, time to death, time to tracheostomy, time to persistent assisted ventilation (DTP), forced vital capacity (% FVC); manual muscle test, maximum voluntary isometric contraction, duration of response, progression-free survival, time to progression of disease, and time-to-treatment failure.

Embodiment 150. The method of any one of 134-149, wherein the method results in improvement in at least two clinically-relevant endpoints selected from the group consisting of ALS Functional Rating Scale (ALSFRS-(R)), combined assessment of function and survival, duration of response, time to death, time to tracheostomy, time to persistent assisted ventilation (DTP), forced vital capacity (% FVC); manual muscle test, maximum voluntary isometric contraction, duration of response, progression-free survival, time to progression of disease, and time-to-treatment failure.

EXAMPLES

Example 1: Creation, Expression and Purification of CasX Stx2

1. Growth and Expression

An expression construct for CasX Stx2 (also referred to herein as CasX2), derived from *Planctomycetes* (having the amino acid sequence of SEQ ID NO: 2 and encoded by the sequence of the Table 5, below), was constructed from gene fragments (Twist Biosciences) that were codon optimized for *E. coli*. The assembled construct contains a TEV-cleavable, C-terminal, TwinStrep tag and was cloned into a pBR322-derivative plasmid backbone containing an ampicillin resistance gene. The expression construct was transformed into chemically competent BL21* (DE3) *E. coli* and a starter culture was grown overnight in LB broth supplemented with carbenicillin at 3TC, 200 RPM, in UltraYield Flasks (Thomson Instrument Company). The following day, this culture was used to seed expression cultures at a 1:100 ratio (starter culture:expression culture). Expression cultures were Terrific Broth (Novagen) supplemented with carbenicillin and grown in UltraYield flasks at 37° C., 200 RPM. Once the cultures reached an OD of 2, they were chilled to 16° C. and IPTG (isopropyl β-D-1-thiogalactopyranoside) was added to a final concentration of 1 mM, from a 1 M stock. The cultures were induced at 16° C., 200 RPM for 20 hours before being harvested by centrifugation at 4,000×g for 15 minutes, 4° C. The cell paste was weighed and resuspended in lysis buffer (50 mM HEPES-NaOH, 250 mM NaCl, 5 mM MgCl$_2$, 1 mM TCEP, 1 mM benzamidine-HCL, 1 mM PMSF, 0.5% CHAPS, 10% glycerol, pH 8) at a ratio of 5 mL of lysis buffer per gram of cell paste. Once resuspended, the sample was frozen at −80° C. until purification.

TABLE 5

DNA sequence of CasX Stx2 construct

| Construct | DNA Sequence |
| --- | --- |
| SV40 NLS-CasX-SV40 NLS-TEV cleavage site - TwinStrep tag | (SEQ ID NO: 206) |

2. Purification

Frozen samples were thawed overnight at 4° C. with magnetic stirring. The viscosity of the resulting lysate was reduced by sonication and lysis was completed by homogenization in three passes at 17 k PSI using an Emulsiflex C3 (Avestin). Lysate was clarified by centrifugation at 50,000× g, 4° C., for 30 minutes and the supernatant was collected. The clarified supernatant was applied to a Heparin 6 Fast Flow column (GE Life Sciences) by gravity flow. The column was washed with 5 CV of Heparin Buffer A (50 mM HEPES-NaOH, 250 mM NaCl, 5 mM MgCl$_2$, 1 mM TCEP, 10% glycerol, pH 8), then with 5 CV of Heparin Buffer B (Buffer A with the NaCl concentration adjusted to 500 mM). Protein was eluted with 5 CV of Heparin Buffer C (Buffer A with the NaCl concentration adjusted to 1 M), collected in fractions. Fractions were assayed for protein by Bradford Assay and protein-containing fractions were pooled. The pooled heparin eluate was applied to a Strep-Tactin XT Superflow column (IBA Life Sciences) by gravity flow. The column was washed with 5 CV of Strep Buffer (50 mM HEPES-NaOH, 500 mM NaCl, 5 mM MgCl$_2$, 1 mM TCEP, 10% glycerol, pH 8). Protein was eluted from the column using 5 CV of Strep Buffer with 50 mM D-Biotin added and collected in fractions. CasX-containing fractions were pooled, concentrated at 4° C. using a 30 kDa cut-off spin concentrator, and purified by size exclusion chromatography on a Superdex 200 pg column (GE Life Sciences). The column was equilibrated with SEC Buffer (25 mM sodium phosphate, 300 mM NaCl, 1 mM TCEP, 10% glycerol, pH 7.25) operated by an AKTA Pure FPLC system (GE Life Sciences). CasX-containing fractions that eluted at the appropriate molecular weight were pooled, concentrated at 4° C. using a 30 kDa cut-off spin concentrator, aliquoted, and snap-frozen in liquid nitrogen before being stored at −80° C.

Results

Figure 2:
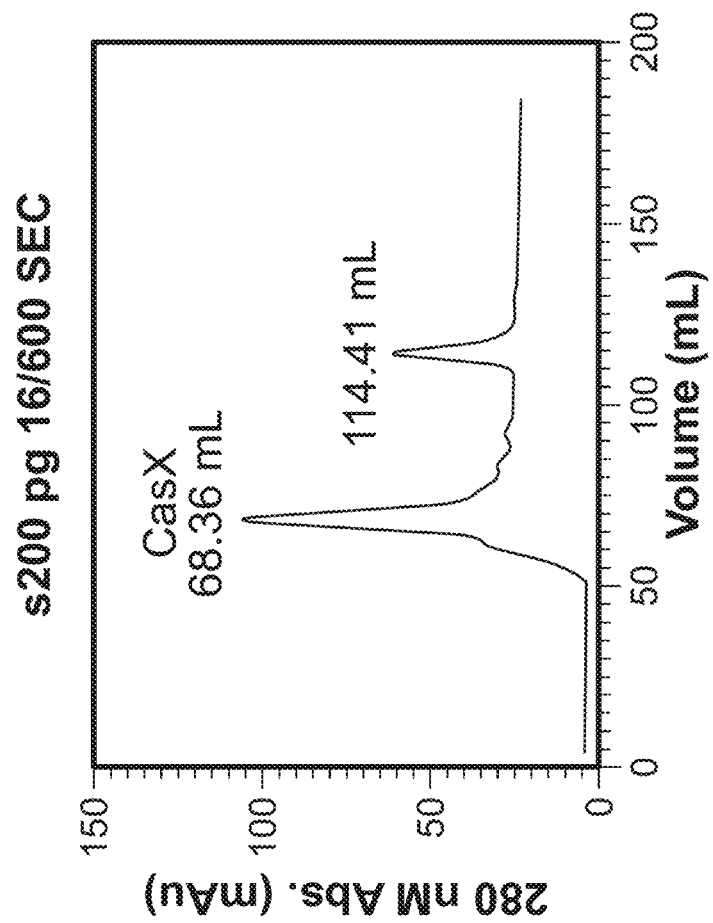
FIG. 2 shows the chromatogram from a size exclusion chromatography assay of the StX2, using of Superdex 200 16/600 pg Gel Filtration, as described in Example 1.
Figure 3:
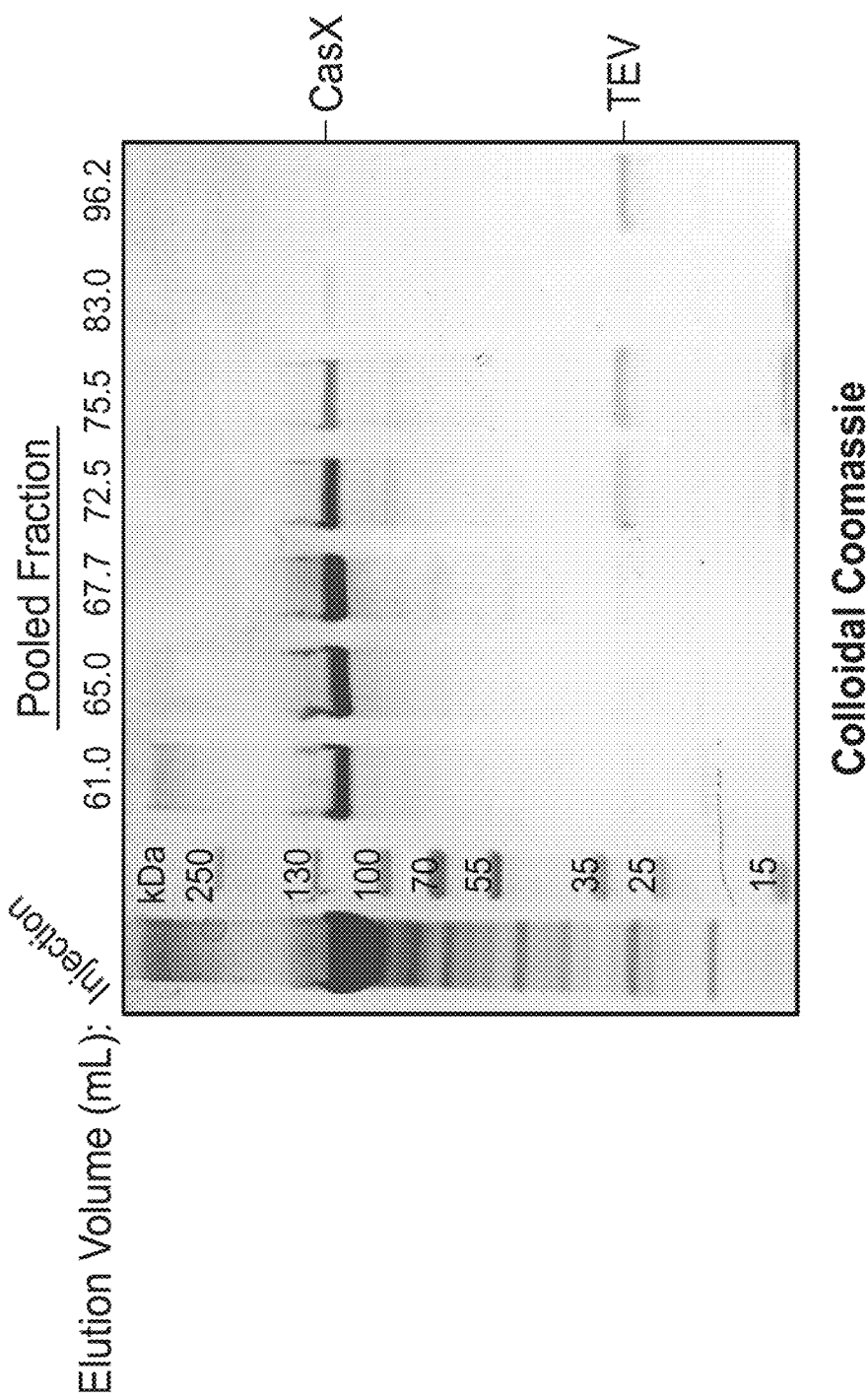
FIG. 3 shows an SDS-PAGE gel of StX2 purification fractions visualized by colloidal Coomassie staining, as described in Example 1.

Samples from throughout the purification were resolved by SDS-PAGE and visualized by colloidal Coomassie staining, as shown in FIG. 1 and FIG. 3. In FIG. 1, the lanes, from left to right, are: molecular weight standards, Pellet: insoluble portion following cell lysis, Lysate: soluble portion following cell lysis, Flow Thru: protein that did not bind the Heparin column, Wash: protein that eluted from the column in wash buffer, Elution: protein eluted from the heparin column with elution buffer, Flow Thru: Protein that did not bind the StrepTactinXT column, Elution: protein eluted from the StrepTactin XT column with elution buffer, Injection: concentrated protein injected onto the s200 gel filtration column, Frozen: pooled fractions from the s200 elution that have been concentrated and frozen. In FIG. 3, the lanes from right to left, are the injection (sample of protein injected onto the gel filtration column,) molecular weight markers, lanes 3-10 are samples from the indicated elution volumes. Results from the gel filtration are shown in FIG. 2. The 68.36 mL peak corresponds to the apparent molecular weight of CasX and contained the majority of CasX protein. The average yield was 0.75 mg of purified

Example 2: CasX Construct 119, 438 and 457

Figure 4:
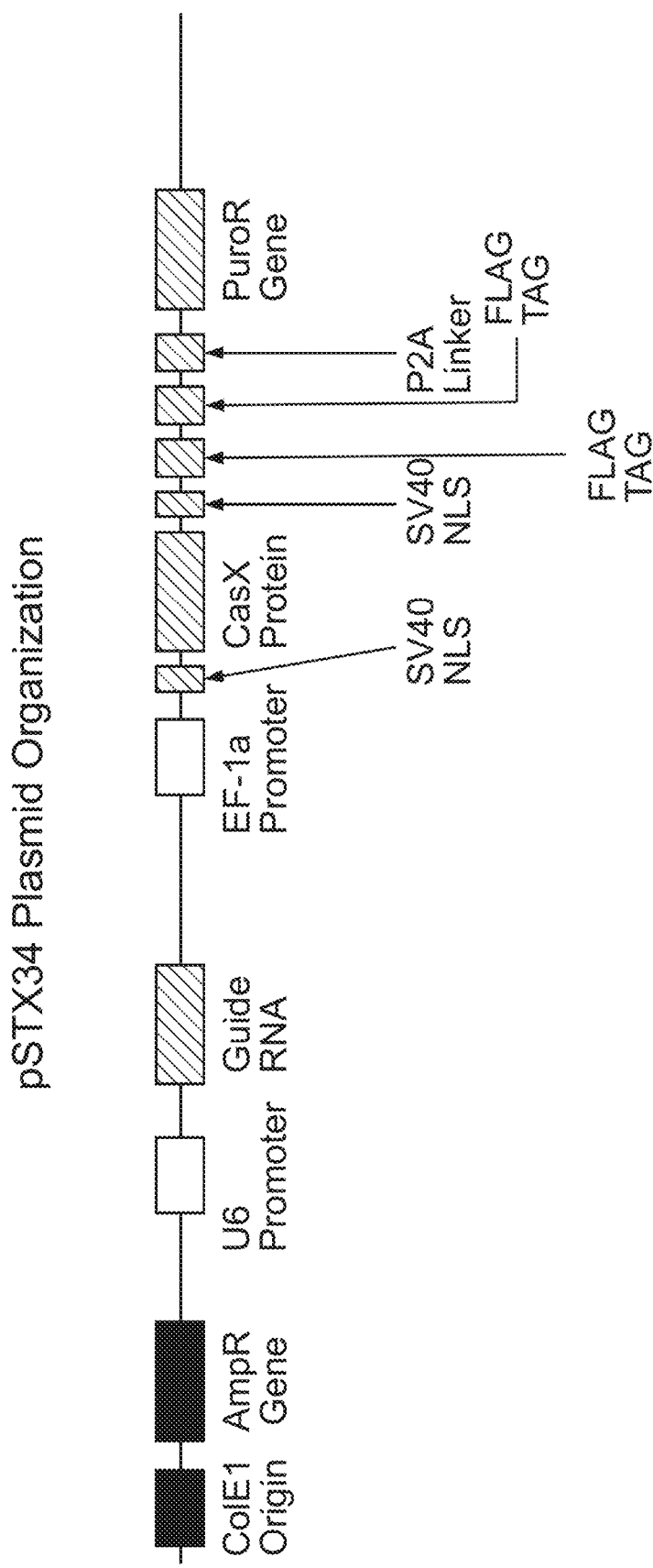
FIG. 4 is a schematic showing the organization of the components in the pSTX34 plasmid used to assemble the CasX constructs, as described in Example 2.
Figure 6:
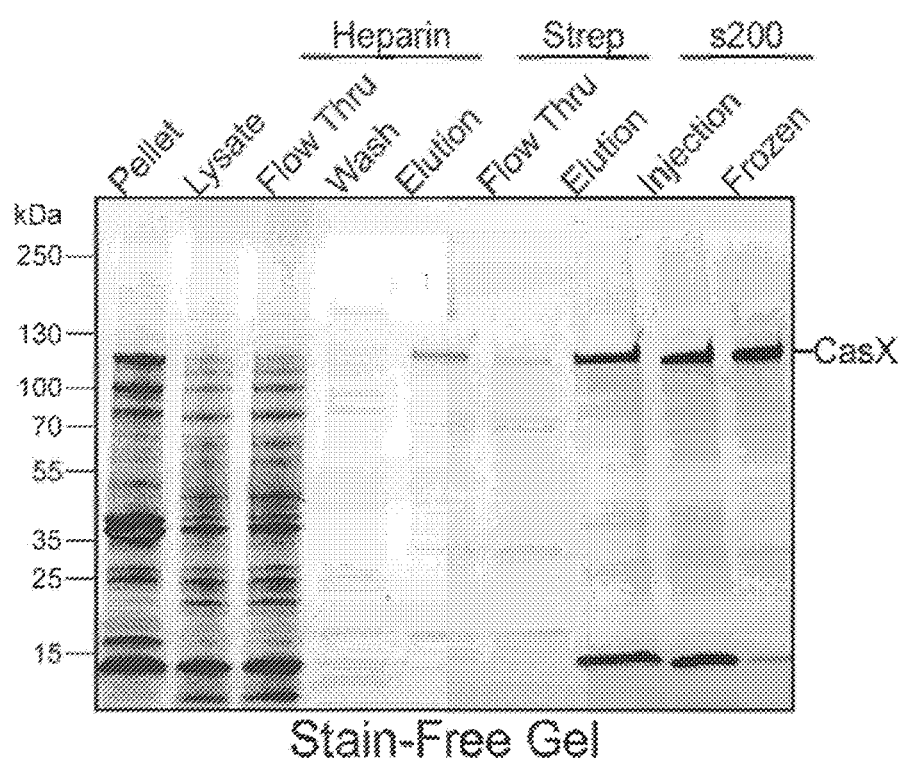
FIG. 6 shows an SDS-PAGE gel of purification samples, visualized on a Bio-Rad Stain-Free™ gel, as described in Example 2.
Figure 7:
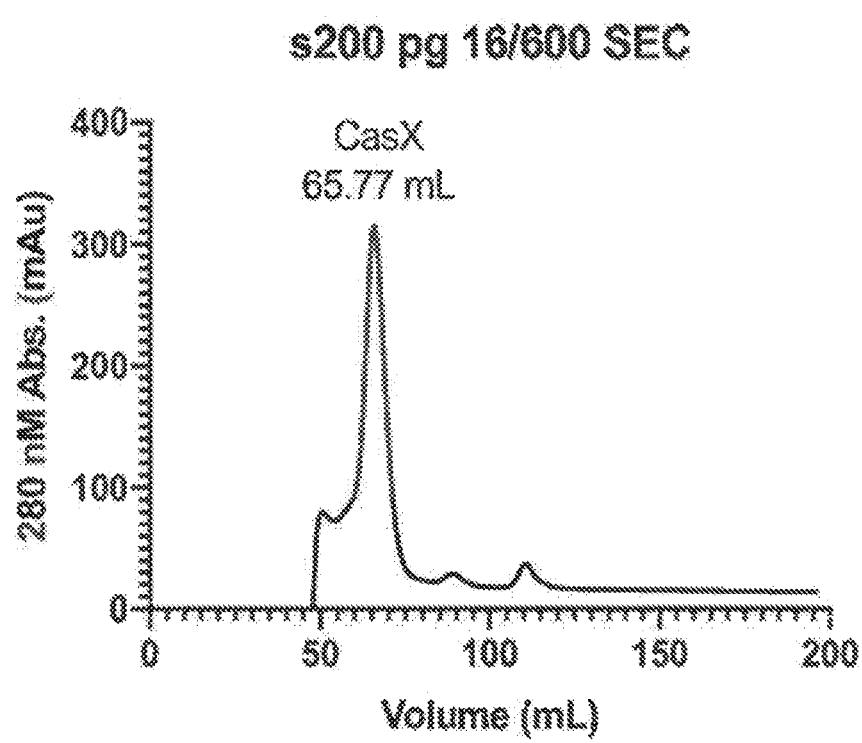
FIG. 7 shows the chromatogram of Superdex 200 16/600 pg Gel Filtration, as described in Example 2.
Figure 8:
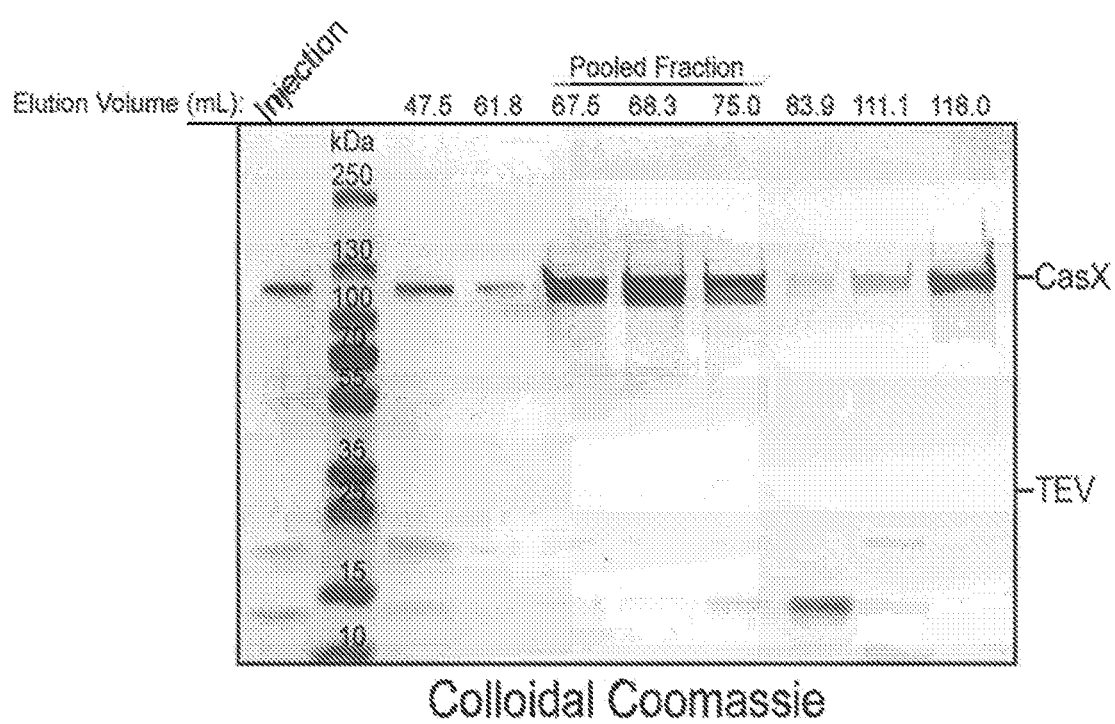
FIG. 8 shows an SDS-PAGE gel of gel filtration samples, stained with colloidal Coomassie, as described in Example 2.

In order to generate the CasX 119, 438, and 457 constructs (sequences in Table 6), the codon-optimized CasX 37 construct (based on the CasX Stx2 construct of Example 1, encoding *Planctomycetes* CasX SEQ ID NO: 2, with a A708K substitution and a [P793] deletion with fused NLS, and linked guide and non-targeting sequences) was cloned into a mammalian expression plasmid (pStX; see FIG. 4) using standard cloning methods. To build CasX 119, the CasX 37 construct DNA was PCR amplified in two reactions using Q5 DNA polymerase (New England BioLabs Cat #M0491L) according to the manufacturer's protocol, using primers oIC539 and oIC88 as well as oIC87 and oIC540 respectively (see FIG. 5). To build CasX 457, the CasX 365 construct DNA was PCR amplified in four reactions using Q5 DNA polymerase (New England BioLabs Cat #M0491L) according to the manufacturer's protocol, using primers oIC539 and oIC212, oIC211 and oIC376, oIC375 and oIC551, and oIC550 and oIC540 respectively. To build CasX 438, the CasX 119 construct DNA was PCR amplified in four reactions using Q5 DNA polymerase (New England BioLabs Cat #M0491L) according to the manufacturer's protocol, using primers oIC539 and oIC689, oIC688 and oIC376, oIC375 and oIC551, and oIC550 and oIC540 respectively. The resulting PCR amplification products were then purified using Zymoclean™ DNA clean and concentrator (Zymo Research Cat #4014) according to the manufacturer's protocol. The pStX backbone was digested using XbaI and SpeI in order to remove the 2931 base pair fragment of DNA between the two sites in plasmid pStx34. The digested backbone fragment was purified by gel extraction from a 1% agarose gel (Gold Bio Cat #A-201-500) using Zymoclean™ Gel DNA Recovery Kit (Zymo Research Cat #D4002) according to the manufacturer's protocol. The three fragments were then pieced together using Gibson assembly® (New England BioLabs Cat #E2621S) following the manufacturer's protocol. Assembled products in the pStx34 were transformed into chemically-competent or electro-competent Turbo Competent *E. coli* bacterial cells, plated on LB-Agar plates (LB: Teknova Cat #L9315, Agar: Quartzy Cat #214510) containing carbenicillin. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. pStX34 includes an EF-1α promoter for the protein as well as a selection marker for both puromycin and carbenicillin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electrocompetent cells such as NEB Turbo competent *E. coli* (NEB Cat #C2984I), plated on LB-Agar plates (LB: Teknova Cat #L9315, Agar: Quartzy Cat #214510) containing carbenicillin. Individual colonies were picked and miniprepped using Qiagen QIAprep® Spin Miniprep Kit (Qiagen Cat #27104) and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX 119 and 457 proteins was performed using the general methodologies of Example 1 (however the DNA sequences were codon optimized for expression in *E. coli*). The results of analytical assays for CasX 119 are shown in FIGS. 6-8. The average yield of the CasX 119 was 1.56 mg of purified CasX protein per liter of culture at 75% purity, as evaluated by colloidal Coomassie staining. FIG. 6 shows an SDS-PAGE gel of purification samples, visualized on a Bio-Rad Stain-Free™ gel, as described. The lanes, from left to right, are: Pellet: insoluble portion following cell lysis, Lysate: soluble portion following cell lysis, Flow Thru: protein that did not bind the Heparin column, Wash: protein that eluted from the column in wash buffer, Elution: protein eluted from the heparin column with elution buffer, Flow Thru: Protein that did not bind the StrepTactinXT column, Elution: protein eluted from the StrepTactin XT column with elution buffer, Injection: concentrated protein injected onto the s200 gel filtration column, Frozen: pooled fractions from the s200 elution that have been concentrated and frozen.

FIG. 7 shows the chromatogram of Superdex 200 16/600 pg Gel Filtration, as described. Gel filtration run of CasX variant 119 protein plotted as 280 nm absorbance against elution volume. The 65.77 mL peak corresponds to the apparent molecular weight of CasX variant 119 and contained the majority of CasX variant 119 protein. FIG. 8 shows an SDS-PAGE gel of gel filtration samples, stained with colloidal Coomassie, as described. Samples from the indicated fractions were resolved by SDS-PAGE and stained with colloidal Coomassie. From right to left, Injection: sample of protein injected onto the gel filtration column, molecular weight markers, lanes 3-10: samples from the indicated elution volumes.

TABLE 6

Sequences of CasX 119, 438 and 457

| Construct | DNA Sequence | Amino Acid Sequence |
|---|---|---|
| CasX 119 | (SEQ ID NO: 207) | QEIKRINKIRRRLVKDSNTKKAGKTGPMKTLLVRVMTPDLRERLE NLRKKPENIPQPISNTSRANLNKLLTDYTEMKKAILHVYWEEFQK DPVGLMSRVAQPAPKNIDQRKLIPVKDGNERLTSSGFACSQCCQP LYVYKLEQVNDKGKPHTNYFGRCNVSEHERLILLSPHKPEANDEL VTYSLGKFGQRALDFYSIHVTRESNHPVKPLEQIGGNSCASGPVG KALSDACMGAVASFLTKYQDIILEHQKVIKKNEKRLANLKDIASA NGLAFPKITLPPQPHTKEGIEAYNNVVAQIVIWVNLNLWQKLKIG |

TABLE 6-continued

Sequences of CasX 119, 438 and 457

| Construct | DNA Sequence | Amino Acid Sequence |
|---|---|---|
| | | RDEAKPLQRLKGFPSFPLVERQANEVDWWDMVCNVKKLINEKKED GKVFWQNLAGYKRQEALRPYLSSEEDRKKGKKFARYQFGDLLLHL EKKHGEDWGKVYDEAWERIDKKVEGLSKHIKLEEERRSEDAQSKA ALTDWLRAKASFVIEGLKEADKDEFCRCELKLQKWYGDLRGKPFA IEAENSILDISGFSKQYNCAFIWQKDGVKKLNLYLIINYFKGGKL RFKKIKPEAFEANRFYTVINKKSGEIVPMEVNFNFDDPNLIILPL AFGKRQGREFIWNDLLSLETGSLKLANGRVIEKTLYNRRTRQDEP ALFVALTFERREVLDSSNIKPMNLIGIDRGENIPAVIALTDPEGC PLSRFKDSLGNPTHILRIGESYKEKQRTIQAKKEVEQRRAGGYSR KYASKAKNLADDMVRNTARDLLYYAVTQDAMLIFENLSRGFGRQG KRTFMAERQYTRMEDWLTAKLAYEGLSKTYLSKTLAQYTSKTCSN CGFTITSADYDRVLEKLKKTATGWMTTINGKELKVEGQITYYNRY KRQNVVKDLSVELDRLSEESVNNDISSWTKGRSGEALSLLKKRFS HRPVQEKFVCLNCGFETHADEQAALNIARSWLFLRSQEYKKYQTN KTTGNTDKRAFVETWQSFYRKKLKEVWKPAV (SEQ ID NO: 208) |
| CasX 457 | (SEQ ID NO: 209) | QEIKRINKIRRRLVKDSNIKKAGKTGPMKTLLVRVMTPDLRERLE NLRKKPENIPQPISNTSRANLNKLLTDYTEMKKAILHVYWEEFQK DPVGLMSRVAQPAPKNIDQRKLIPVKDGNERLTSSGFACSQCCQP LYVYKLEQVNDKGKPHTNYFGRCNVSEHERLILLSPHKPEANDEL VTYSLGKFGQRALDFYSIHVTRESNHPVKPLEQIGGNSCASGPVG KALSDACMGAVASFLTKYQDIILEHKKVIKKNEKRLANLKDIASA NGLAFPKITLPPQPHTKEGIEAYNNVVAQIVIWVNLNLWQKLKIG RDEAKPLQRLKGFPSFPLVERQANEVDWWDMVCNVKKLINEKKED GKVFWQNLAGYKRQEALRPYLSSPEDRKKGKKFARYQLGDLLLHL EKKHGEDWGKVYDEAWERIDKKVEGLSKHIKLEEERRSEDAQSKA ALTDWLRAKASFVIEGLKEADKDEFCRCELKLQKWYGDLRGKPFA IEAENSILDISGFSKQYNCAFIWQKDGVKKLNLYLIINYFKGGKL RFKKIKPEAFEANRFYTVINKKSGEIVPMEVNFNFDDPNLIILPL AFGKRQGREFIWNDLLSLETGSLKLANGRVIEKPLYNRRTRQDEP ALFVALTFERREVLDSSNIKPMNLIGVDRGENIPAVIALTDPEGC PLSRFKDSLGNPTHILRIGESYKEKQRTIQAKKEVEQRRAGGYSR KYASKAKNLADDMVRNTARDLLYYAVTQDAMLIFENLSRGFGRQG KRTFMAERQYTRMEDWLTAKLAYEGLSKTYLSKTLAQYTSKTCSN CGFTITSADYDRVLEKLKKTATGWMTTINGKELKVEGQITYYNRR KRQNVVKDLSVELDRLSEESVNNDISSWTKGRSGEALSLLKKRFS HRPVQEKFVCLNCGFETHADEQAALNIARSWLFLRSQEYKKYQTN KTTGNTDKRAFVETWQSFYRKKLKEVWKPAV (SEQ ID NO: 210) |
| CasX 438 | SEQ ID NO: 211) | QEIKRINKIRRRLVKDSNIKKAGKTGPMKTLLVRVMTPDLRERLE NLRKKPENIPQPISNTSRANLNKLLTDYTEMKKAILHVYWEEFQK DPVGLMSRVAQPAPKNIDQRKLIPVKDGNERLTSSGFACSQCCQP LYVYKLEQVNDKGKPHTNYFGRCNVSEHERLILLSPHKPEANDEL VTYSLGKFGQRALDFYSIHVTRESNHPVKPLEQIGGNSCASGPVG KALSDACMGAVASFLTKYQDIILEHQKVIKKNEKRLANLKDIASA NGLAFPKITLPPQPHTKEGIEAYNNVVAQIVIWVNLNLWQKLKIG RDEAKPLQRLKGFPSFPLVERQANEVDWWDMVCNVKKLINEKKED GKVFWQNLAGYKRQEALRPYLSSEEDRKKGKKFARYQLGDLLKHL EKKHGEDWGKVYDEAWERIDKKVEGLSKHIKLEEERRSEDAQSKA ALTDWLRAKASFVIEGLKEADKDEFCRCELKLQKWYGDLRGKPFA IEAENSILDISGFSKQYNCAFIWQKDGVKKLNLYLIINYFKGGKL RFKKIKPEAFEANRFYTVINKKSGEIVPMEVNFNFDDPNLIILPL AFGKRQGREFIWNDLLSLETGSLKLANGRVIEKTLYNRRTRQDEP ALFVALTFERREVLDSSNIKPMNLIGVDRGENIPAVIALTDPEGC PLSRFKDSLGNPTHILRIGESYKEKQRTIQAKKEVEQRRAGGYSR KYASKAKNLADDMVRNTARDLLYYAVTQDAMLIFENLSRGFGRQG KRTFMAERQYTRMEDWLTAKLAYEGLSKTYLSKTLAQYTSKTCSN CGFTITSADYDRVLEKLKKTATGWMTTINGKELKVEGQITYYNRR KRQNVVKDLSVELDRLSEESVNNDISSWTKGRSGEALSLLKKRFS HRPVQEKFVCLNCGFETHADEQAALNIARSWLFLRSQEYKKYQTN KTTGNTDKRAFVETWQSFYRKKLKEVWKPAV (SEQ ID NO: 212) |

Example 3: CasX Construct 488 and 491

In order to generate the CasX 488 construct (sequences in Table 7), the codon-optimized CasX 119 construct (based on the CasX Stx2 construct of Example 1, encoding *Planctomycetes* CasX SEQ ID NO: 2, with a A708K substitution, a L379R substitution, and a [P793] deletion with fused NLS, and linked guide and non-targeting sequences) was cloned into a mammalian expression plasmid (pStX; see FIG. 4) using standard cloning methods. Construct CasX 1 (based on the CasX Stx1 construct of Example 1, encoding CasX SEQ ID NO: 1) was cloned into a destination vector using standard cloning methods. To build CasX 488, the CasX 119 construct DNA was PCR amplified using Q5 DNA polymerase (New England BioLabs Cat #M0491L) according to the manufacturer's protocol, using primers oIC765 and oIC762 (see FIG. 5). The CasX 1 construct was PCR amplified using Q5 DNA polymerase (New England BioLabs Cat #M0491L) according to the manufacturer's protocol, using primers oIC766 and oIC784. The PCR products were purified by gel extraction from a 1% agarose gel (Gold Bio Cat #A-201-500) using Zymoclean™ Gel DNA Recovery Kit (Zymo Research Cat #D4002) according to the manufacturer's protocol. The two fragments were then pieced together using Gibson assembly® (New England BioLabs Cat #E2621S) following the manufacturer's protocol. Assembled products in pStx1 were transformed into chemically-competent Turbo Competent E. coli bacterial cells, plated on LB-Agar plates (LB: Teknova Cat #L9315, Agar: Quartzy Cat #214510) containing kanamycin. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. The correct clones were then subcloned into the mammalian expression vector pStx34 using restriction enzyme cloning. The pStx34 backbone and the CasX 488 clone in pStx1 were digested with XbaI and BamHI respectively. The digested backbone and insert fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The clean backbone and insert were then ligated together using T4 Ligase (New England Biolabs Cat #M0202L) according to the manufacturer's protocol. The ligated product was transformed into chemically-competent Turbo Competent E. coli bacterial cells, plated on LB-Agar plates (LB: Teknova Cat #L9315, Agar: Quartzy Cat #214510) containing carbenicillin. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly.

Figure 5:
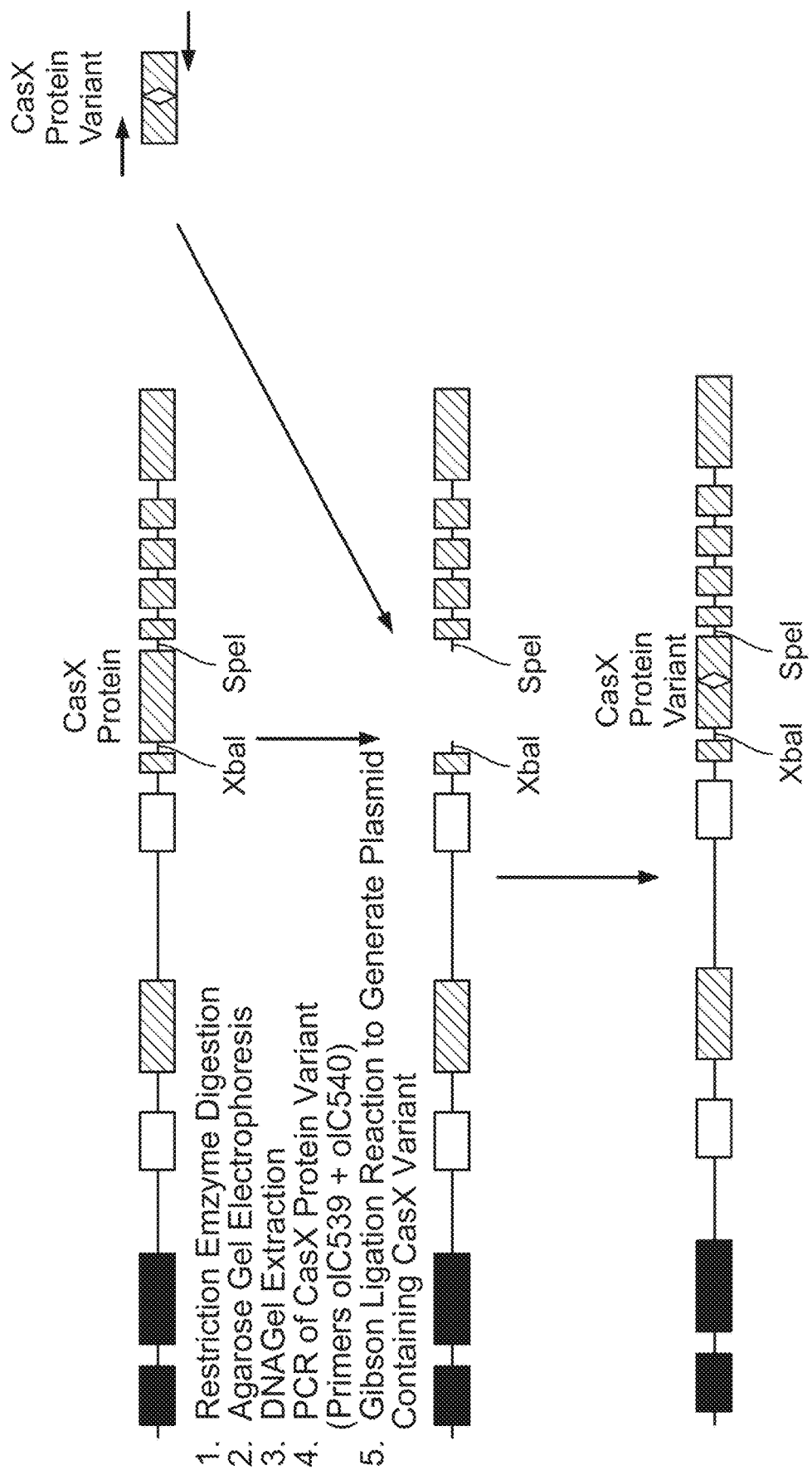
FIG. 5 is a schematic showing the steps of generating the CasX 119 variant, as described in Example 2.

In order to generate CasX 491 (sequences in Table 7), the CasX 484 construct DNA was PCR amplified using Q5 DNA polymerase (New England BioLabs Cat #M0491L) according to the manufacturer's protocol, using primers oIC765 and oIC762 (see FIG. 5). The CasX 1 construct was PCR amplified using Q5 DNA polymerase (New England BioLabs Cat #M0491L) according to the manufacturer's protocol, using primers oIC766 and oIC784. The PCR products were purified by gel extraction from a 1% agarose gel (Gold Bio Cat #A-201-500) using Zymoclean™ Gel DNA Recovery Kit (Zymo Research Cat #D4002) according to the manufacturer's protocol. The two fragments were then pieced together using Gibson assembly® (New England BioLabs Cat #E2621S) following the manufacturer's protocol. Assembled products in pStx1 were transformed into chemically-competent Turbo Competent E. coli bacterial cells, plated on LB-Agar plates (LB: Teknova Cat #L9315, Agar: Quartzy Cat #214510) containing kanamycin. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. The correct clones were then subcloned into the mammalian expression vector pStx34 using restriction enzyme cloning. The pStx34 backbone and the CasX 491 clone in pStx1 were digested with XbaI and BamHI respectively. The digested backbone and insert fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The clean backbone and insert were then ligated together using T4 Ligase (New England Biolabs Cat #M0202L) according to the manufacturer's protocol. The ligated product was transformed into chemically-competent Turbo Competent E. coli bacterial cells, plated on LB-Agar plates (LB: Teknova Cat #L9315, Agar: Quartzy Cat #214510) containing carbenicillin. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. pStX34 includes an EF-1α promoter for the protein as well as a selection marker for both puromycin and carbenicillin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England Biolabs Cat #M0202L) and an appropriate restriction enzyme for the plasmid. Golden Gate products were transformed into chemically or electro-competent cells such as NEB Turbo competent E. coli (NEB Cat #C2984I), plated on LB-Agar plates (LB: Teknova Cat #L9315, Agar: Quartzy Cat #214510) containing carbenicillin. Individual colonies were picked and miniprepped using Qiagen QIAprep® Spin Miniprep Kit (Qiagen Cat #27104) and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX constructs was performed using the general methodologies of Example 1 and Example 2, with similar results obtained.

TABLE 7

Sequences of CasX 488 and 491

| Construct | DNA Sequence | Amino Acid Sequence |
|---|---|---|
| CasX 488 | (SEQ ID NO: 213) | QEIKRINKIRRRLVKDSNTKKAGKTGPMKTLLVRVMTPDLRERLE NLRKKPENIPQPISNTSRANLNKLLTDYTEMKKAILHVYWEEFQK DPVGLMSRVAQPASKKIDQNKLKPEMDEKGNLTTAGFACSQCGQP LFVYKLEQVSEKGKAYTNYFGRCNVAEHEKLILLAQLKPEKDSDE AVTYSLGKFGQRALDFYSIHVTKESTHPVKPLAQIAGNRYASGPV GKALSDACMGTIASFLSKYQDIIIEHQKVVKGNQKRLESLRELAG |

TABLE 7-continued

Sequences of CasX 488 and 491

| Construct | DNA Sequence | Amino Acid Sequence |
|---|---|---|
| | | KENLEYPSVTLPPQPHTKEGVDAYNEVIARVRMWVNLNLWQKLKL<br>SRDDAKPLLRLKGFPSFPLVERQANEVDWWDMVCNVKKLINEKKE<br>DGKVFWQNLAGYKRQEALRPYLSSEEDRKKGKKFARYQFGDLLLH<br>LEKKHGEDWGKVYDEAWERIDKKVEGLSKHIKLEEERRSEDAQSK<br>AALTDWLRAKASFVIEGLKEADKDEFCRCELKLQKWYGDLRGKPF<br>AIEAENSILDISGFSKQYNCAFIWQKDGVKKLNLYLIINYFKGGK<br>LRFKKIKPEAFEANRFYTVINKKSGEIVPMEVNFNFDDPNLIILP<br>LAFGKRQGREFIWNDLLSLETGSLKLANGRVIEKTLYNRRTRQDE<br>PALFVALTFERREVLDSSNIKPMNLIGIDRGENIPAVIALTDPEG<br>CPLSRFKDSLGNPTHILRIGESYKEKQRTIQAKKEVEQRRAGGYS<br>RKYASKAKNLADDMVRNTARDLLYYAVTQDAMLIFENLSRGFGRQ<br>GKRTFMAERQYTRMEDWLTAKLAYEGLSKTYLSKTLAQYTSKTCS<br>NCGFTITSADYDRVLEKLKKTATGWMTTINGKELKVEGQITYYNR<br>YKRQNVVKDLSVELDRLSEESVNNDISSWTKGRSGEALSLLKKRF<br>SHRPVQEKFVCLNCGFETHADEQAALNIARSWLFLRSQEYKKYQT<br>NKTTGNTDKRAFVETWQSFYRKKLKEVWKPAV<br>(SEQ ID NO: 214) |
| CasX 491 | (SEQ ID NO: 215) | QEIKRINKIRRRLVKDSNTKKAGKTGPMKTLLVRVMTPDLRERLE<br>NLRKKPENIPQPISNTSRANLNKLLTDYTEMKKAILHVYWEEFQK<br>DPVGLMSRVAQPASKKIDQNKLKPEMDEKGNLTTAGFACSQCGQP<br>LFVYKLEQVSEKGKAYTNYFGRCNVAEHEKLILLAQLKPEKDSDE<br>AVTYSLGKFGQRALDFYSIHVTKESTHPVKPLAQIAGNRYASGPV<br>GKALSDACMGTIASFLSKYQDIIIEHQKVVKGNQKRLESLRELAG<br>KENLEYPSVTLPPQPHTKEGVDAYNEVIARVRMWVNLNLWQKLKL<br>SRDDAKPLLRLKGFPSFPLVERQANEVDWWDMVCNVKKLINEKKE<br>DGKVFWQNLAGYKRQEALRPYLSSEEDRKKGKKFARYQLGDLLLH<br>LEKKHGEDWGKVYDEAWERIDKKVEGLSKHIKLEEERRSEDAQSK<br>AALTDWLRAKASFVIEGLKEADKDEFCRCELKLQKWYGDLRGKPF<br>AIEAENSILDISGFSKQYNCAFIWQKDGVKKLNLYLIINYFKGGK<br>LRFKKIKPEAFEANRFYTVINKKSGEIVPMEVNFNFDDPNLIILP<br>LAFGKRQGREFIWNDLLSLETGSLKLANGRVIEKTLYNRRTRQDE<br>PALFVALTFERREVLDSSNIKPMNLIGVDRGENIPAVIALTDPEG<br>CPLSRFKDSLGNPTHILRIGESYKEKQRTIQAKKEVEQRRAGGYS<br>RKYASKAKNLADDMVRNTARDLLYYAVTQDAMLIFENLSRGFGRQ<br>GKRTFMAERQYTRMEDWLTAKLAYEGLSKTYLSKTLAQYTSKTCS<br>NCGFTITSADYDRVLEKLKKTATGWMTTINGKELKVEGQITYYNR<br>YKRQNVVKDLSVELDRLSEESVNNDISSWTKGRSGEALSLLKKRF<br>SHRPVQEKFVCLNCGFETHADEQAALNIARSWLFLRSQEYKKYQT<br>NKTTGNTDKRAFVETWQSFYRKKLKEVWKPAV<br>(SEQ ID NO: 216) |

Example 4: Design and Generation of CasX Constructs 278-280, 285-288, 290, 291, 293, 300, 492, and 493

In order to generate the CasX 278-280, 285-288, 290, 291, 293, 300, 492, and 493 constructs (sequences in Table 8), the N- and C-termini of the codon-optimized CasX 119 construct (based on the CasX Stx37 construct of Example 2, encoding Planctomycetes CasX SEQ ID NO: 2, with a A708K substitution and a [P793] deletion with fused NLS, and linked guide and non-targeting sequences) in a mammalian expression vector were manipulated to delete or add NLS sequences (sequences in Table 9). Constructs 278, 279, and 280 were manipulations of the N- and C-termini using only an SV40 NLS sequence. Construct 280 had no NLS on the N-terminus and added two SV40 NLS' on the C-terminus with a triple proline linker in between the two SV40 NLS sequences. Constructs 278, 279, and 280 were made by amplifying pStx34.119.174.NT with Q5 DNA polymerase (New England BioLabs Cat #M0491L) according to the manufacturer's protocol, using primers oIC527 and oIC528, oIC730 and oIC522, and oIC730 and oIC530 for the first fragments each and using oIC529 and oIC520, oIC519 and oIC731, and oIC529 and oIC731 to create the second fragments each. These fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The respective fragments were cloned together using Gibson assembly® (New England BioLabs Cat #E2621S) following the manufacturer's protocol. Assembled products in the pStx34 were transformed into chemically-competent Turbo Competent E. coli bacterial cells, plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent E. coli (NEB Cat #C2984I), plated on LB-Agar plates (LB: Teknova Cat

L9315, Agar: Quartzy Cat #214510) containing carbenicillin and incubated at 37° C. Individual colonies were picked and miniprepped using Qiagen QIAprep® Spin Miniprep Kit (Qiagen Cat #27104) and following the manufacturer's protocol. The resultant plasmids were sequenced using Sanger sequencing to ensure correct ligation.

In order to generate constructs 285-288, 290, 291, 293, and 300, a nested PCR method was used for cloning. The backbone vector and PCR template used was construct pStx34 279.119.174.NT, having the CasX 119, guide 174, and non-targeting spacer (see Examples 8 and 9 and Tables therein for sequences). Construct 278 has the configuration SV40NLS-CasX119. Construct 279 has the configuration CasX119-SV40NLS. Construct 280 has the configuration CasX119-SV40NLS-PPP linker-SV40NLS. Construct 285 has the configuration CasX119-SV40NLS-PPP linker-SynthNLS3. Construct 286 has the configuration CasX119-SV40NLS-PPP linker-SynthNLS4. Construct 287 has the configuration CasX119-SV40NLS-PPP linker-SynthNLS5. Construct 288 has the configuration CasX119-SV40NLS-PPP linker-SynthNLS6. Constrict 290 has the configuration CasX119-SV40NLS-PPPlinker-EGL-13 NLS. Construct 291 has the configuration CasX119-SV40NLS-PPP linker-c-Myc NLS. Construct 293 has the configuration CasX119-SV40NLS-PPP linker-Nucleolar RNA Helicase II NLS. Construct 300 has the configuration CasX119-SV40NLS-PPP linker-Influenza A protein NLS. Construct 492 has the configuration SV40NLS-CasX119-SV40NLS-PPP linker-SV40NLS. Construct 493 has the configuration SV40NLS-CasX119-SV40NLS-PPP linker-c-Myc NLS. Each variant had a set of three PCRs; two of which were nested, were purified by gel extraction, digested, and then ligated into the digested and purified backbone. Assembled products in the pStx34 were transformed into chemically-competent Turbo Competent E. coli bacterial cells, plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into the resulting pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent E. coli (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) and following the manufacturer's protocol. The resultant plasmids were sequenced using Sanger sequencing to ensure correct ligation.

In order to generate constructs 492 and 493, constructs 280 and 291 were digested using XbaI and BamHI (NEB #R0145S and NEB #R3136S) according to the manufacturer's protocol. Next, they were purified by gel extraction from a 1% agarose gel (Gold Bio Cat #A-201-500) using Zymoclean™ Gel DNA Recovery Kit (Zymo Research Cat #D4002) according to the manufacturer's protocol. Finally, they were ligated using T4 DNA ligase (NEB #M0202S) according to the manufacturer's protocol into the digested and purified pStx34.119.174.NT using XbaI and BamHI and Zymoclean™ Gel DNA Recovery Kit. Assembled products in the pStx34 were transformed into chemically-competent Turbo Competent E. coli bacterial cells, plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. Sequences encoding the targeting spacer sequences that target the gene of interest were designed based on CasX PAM locations. Targeting sequence DNA was ordered as single-stranded DNA (ssDNA) oligos (Integrated DNA Technologies) consisting of the targeting spacer sequence and the reverse complement of this sequence. These two oligos were annealed together and cloned into each pStX individually or in bulk by Golden Gate assembly using T4 DNA Ligase (New England BioLabs Cat #M0202L) and an appropriate restriction enzyme for the respective plasmids. Golden Gate products were transformed into chemically- or electro-competent cells such as NEB Turbo competent E. coli (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) and following the manufacturer's protocol. The resultant plasmids were sequenced using Sanger sequencing to ensure correct ligation. The plasmids would be used to produce and recover CasX protein utilizing the general methodologies of Examples 1 and 2.

TABLE 8

CasX 278-280, 285-288, 290, 291, 293, 300, 492, and 493 sequences

| Construct | Amino Acid Sequence |
|---|---|
| 278 | MAPKKKRKVSRQEIKRINKIRRRLVKDSNTKKAGKTGPMKTLLVRVMTPDLRERL ENLRKKPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKGKPHTNY FGRCNVSEHERLILLSPHKPEANDELVTYSLGKFGQRALDFYSIHVTRESNHPVK PLEQIGGNSCASGPVGKALSDACMGAVASFLTKYQDIILEHQKVIKKNEKRLANL KDIASANGLAFPKITLPPQPHTKEGIEAYNNVVAQIVIWVNLNLWQKLKIGRDEA KPLQRLKGFPSFPLVERQANEVDWWDMVCNVKKLINEKKEDGKVFWQNLAGYKRQ EALRPYLSSEEDRKKGKKFARYQFGDLLLHLEKKHGEDWGKVYDEAWERIDKKVE GLSKHIKLEEERRSEDAQSKAALTDWLRAKASFVIEGLKEADKDEFCRCELKLQK WYGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVLDSSNI |

TABLE 8-continued

CasX 278-280, 285-288, 290, 291, 293, 300, 492, and 493 sequences

| Construct | Amino Acid Sequence |
|---|---|
| | KPMNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAMLIFENLSR<br>GFGRQGKRTFMAERQYTRMEDWLTAKLAYEGLSKTYLSKTLAQYTSKTCSNCGFT<br>ITSADYDRVLEKLKKTATGWMTTINGKELKVEGQITYYNRYKRQNVVKDLSVELD<br>RLSEESVNNDISSWTKGRSGEALSLLKKRFSHRPVQEKFVCLNCGFETHADEQAA<br>LNIARSWLFLRSQEYKKYQTNKTTGNTDKRAFVETWQSFYRKKLKEVWKPAV<br>(SEQ ID NO: 217) |
| 279 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC<br>ASGPVGKALSDACMGAVASFLTKYQDIILEHQKVIKKNEKRLANLKDIASANGLA<br>FPKITLPPQPHTKEGIEAYNNVVAQIVIWVNLNLWQKLKIGRDEAKPLQRLKGFP<br>SFPLVERQANEVDWWDMVCNVKKLINEKKEDGKVFWQNLAGYKRQEALRPYLSSE<br>EDRKKGKKFARYQFGDLLLHLEKKHGEDWGKVYDEAWERIDKKVEGLSKHIKLEE<br>ERRSEDAQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIKPEA<br>FEANRFYTVINKKSGEIVPMEVNFNFDDPNLIILPLAFGKRQGREFIWNDLLSLE<br>TGSLKLANGRVIEKTLYNRRTRQDEPALFVALTFERREVLDSSNIKPMNLIGIDR<br>GENIPAVIALTDPEGCPLSRFKDSLGNPTHILRIGESYKEKQRTIQAKKEVEQRR<br>AGGYSRKYASKAKNLADDMVRNTARDLLYYAVTQDAMLIFENLSRGFGRQGKRTF<br>MAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNND<br>ISSWTKGRSGEALSLLKKRFSHRPVQEKFVCLNCGFETHADEQAALNIARSWLFL<br>RSQEYKKYQTNKTTGNTDKRAFVETWQSFYRKKLKEVWKPAVTSPKKKRKV<br>(SEQ ID NO: 218) |
| 280 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC<br>ASGPVGKALSDACMGAVASFLTKYQDIILEHQKVIKKNEKRLANLKDIASANGLA<br>FPKITLPPQPHTKEGIEAYNNVVAQIVIWVNLNLWQKLKIGRDEAKPLQRLKGFP<br>SFPLVERQANEVDWWDMVCNVKKLINEKKEDGKVFWQNLAGYKRQEALRPYLSSE<br>EDRKKGKKFARYQFGDLLLHLEKKHGEDWGKVYDEAWERIDKKVEGLSKHIKLEE<br>ERRSEDAQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIKPEA<br>FEANRFYTVINKKSGEIVPMEVNFNFDDPNLIILPLAFGKRQGREFIWNDLLSLE<br>TGSLKLANGRVIEKTLYNRRTRQDEPALFVALTFERREVLDSSNIKPMNLIGIDR<br>GENIPAVIALTDPEGCPLSRFKDSLGNPTHILRIGESYKEKQRTIQAKKEVEQRR<br>AGGYSRKYASKAKNLADDMVRNTARDLLYYAVTQDAMLIFENLSRGFGRQGKRTF<br>MAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNND<br>ISSWTKGRSGEALSLLKKRFSHRPVQEKFVCLNCGFETHADEQAALNIARSWLFL<br>RSQEYKKYQTNKTTGNTDKRAFVETWQSFYRKKLKEVWKPAVTSPKKKRKVPPPP<br>KKKRKV (SEQ ID NO: 219) |
| 285 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC<br>ASGPVGKALSDACMGAVASFLTKYQDIILEHQKVIKKNEKRLANLKDIASANGLA<br>FPKITLPPQPHTKEGIEAYNNVVAQIVIWVNLNLWQKLKIGRDEAKPLQRLKGFP<br>SFPLVERQANEVDWWDMVCNVKKLINEKKEDGKVFWQNLAGYKRQEALRPYLSSE<br>EDRKKGKKFARYQFGDLLLHLEKKHGEDWGKVYDEAWERIDKKVEGLSKHIKLEE<br>ERRSEDAQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIKPEA<br>FEANRFYTVINKKSGEIVPMEVNFNFDDPNLIILPLAFGKRQGREFIWNDLLSLE<br>TGSLKLANGRVIEKTLYNRRTRQDEPALFVALTFERREVLDSSNIKPMNLIGIDR<br>GENIPAVIALTDPEGCPLSRFKDSLGNPTHILRIGESYKEKQRTIQAKKEVEQRR<br>AGGYSRKYASKAKNLADDMVRNTARDLLYYAVTQDAMLIFENLSRGFGRQGKRTF<br>MAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNND<br>ISSWTKGRSGEALSLLKKRFSHRPVQEKFVCLNCGFETHADEQAALNIARSWLFL<br>RSQEYKKYQTNKTTGNTDKRAFVETWQSFYRKKLKEVWKPAVTSPKKKRKVPPPH<br>KKKHPDASVNFSEFSK (SEQ ID NO: 220) |
| 286 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC<br>ASGPVGKALSDACMGAVASFLTKYQDIILEHQKVIKKNEKRLANLKDIASANGLA<br>FPKITLPPQPHTKEGIEAYNNVVAQIVIWVNLNLWQKLKIGRDEAKPLQRLKGFP<br>SFPLVERQANEVDWWDMVCNVKKLINEKKEDGKVFWQNLAGYKRQEALRPYLSSE<br>EDRKKGKKFARYQFGDLLLHLEKKHGEDWGKVYDEAWERIDKKVEGLSKHIKLEE |

TABLE 8-continued

CasX 278-280, 285-288, 290, 291, 293, 300, 492, and 493 sequences

| Construct | Amino Acid Sequence |
|---|---|
| | ERRSEDAQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIKPEA<br>FEANRFYTVINKKSGEIVPMEVNFNFDDPNLIILPLAFGKRQGREFIWNDLLSLE<br>TGSLKLANGRVIEKTLYNRRTRQDEPALFVALTFERREVLDSSNIKPMNLIGIDR<br>GENIPAVIALTDPEGCPLSRFKDSLGNPTHILRIGESYKEKQRTIQAKKEVEQRR<br>AGGYSRKYASKAKNLADDMVRNTARDLLYYAVTQDAMLIFENLSRGFGRQGKRTF<br>MAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNND<br>ISSWTKGRSGEALSLLKKRFSHRPVQEKFVCLNCGFETHADEQAALNIARSWLFL<br>RSQEYKKYQTNKTTGNTDKRAFVETWQSFYRKKLKEVWKPAVTSPKKKRKVPPPQ<br>RPGPYDRPQRPGPYDRP (SEQ ID NO: 221) |
| 287 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC<br>ASGPVGKALSDACMGAVASFLTKYQDIILEHQKVIKKNEKRLANLKDIASANGLA<br>FPKITLPPQPHTKEGIEAYNNVVAQIVIWVNLNLWQKLKIGRDEAKPLQRLKGFP<br>SFPPLVERQANEVDWWDMVCNVKKLINEKKEDGKVFWQNLAGYKRQEALRPYLSSE<br>EDRKKGKKFARYQFGDLLLHLEKKHGEDWGKVYDEAWERIDKKVEGLSKHIKLEE<br>ERRSEDAQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIKPEA<br>FEANRFYTVINKKSGEIVPMEVNFNFDDPNLIILPLAFGKRQGREFIWNDLLSLE<br>TGSLKLANGRVIEKTLYNRRTRQDEPALFVALTFERREVLDSSNIKPMNLIGIDR<br>GENIPAVIALTDPEGCPLSRFKDSLGNPTHILRIGESYKEKQRTIQAKKEVEQRR<br>AGGYSRKYASKAKNLADDMVRNTARDLLYYAVTQDAMLIFENLSRGFGRQGKRTF<br>MAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNND<br>ISSWTKGRSGEALSLLKKRFSHRPVQEKFVCLNCGFETHADEQAALNIARSWLFL<br>RSQEYKKYQTNKTTGNTDKRAFVETWQSFYRKKLKEVWKPAVTSPKKKRKVPPPL<br>SPSLSPLLSPSLSPL (SEQ ID NO: 222) |
| 288 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTMSSGFACSQCCQPLYVYKLEQVNDKGKPHTNYFGRCNVSEH<br>ERLILLSPHKPEANDELVTYSLGKFGQRALDFYSIHVTRESNHPVKPLEQIGGNS<br>CASGPVGKALSDACMGAVASFLTKYQDIILEHQKVIKKNEKRLANLKDIASANGL<br>AFPKITLPPQPHTKEGIEAYNNVVAQIVIWVNLNLWQKLKIGRDEAKPLQRLKGF<br>PSFPLVERQANEVDWWDMVCNVKKLINEKKEDGKVFWQNLAGYKRQEALRPYLSS<br>EEDRKKGKKFARYQFGDLLLHLEKKHGEDWGKVYDEAWERIDKKVEGLSKHIKLE<br>EERRSEDAQSKAALTDWLRAKASFVIEGLKEADKDEFCRCELKLQKWYGDLRGKP<br>FAIEAENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDLLSL<br>ETGSLKLANGRVIEKTLYNRRTRQDEPALFVALTFERREVLDSSNIKPMNLIGID<br>RGENIPAVIALTDPEGCPLSRFKDSLGNPTHILRIGESYKEKQRTIQAKKEVEQR<br>RAGGYSRKYASKAKNLADDMVRNTARDLLYYAVTQDAMLIFENLSRGFGRQGKRT<br>FMAERQYTRMEDWLTAKLAYEGLSKTYLSKTLAQYTSKTCSNCGFTITSADYDRV<br>LEKLKKTATGWMTTINGKELKVEGQITYYNRYKRQNVVKDLSVELDRLSEESVNN<br>DISSWTKGRSGEALSLLKKRFSHRPVQEKFVCLNCGFETHADEQAALNIARSWLF<br>LRSQEYKKYQTNKTTGNTDKRAFVETWQSFYRKKLKEVWKPAVTSPKKKRKVPPP<br>RGKGGKGLGKGGAKRHRK (SEQ ID NO: 223) |
| 290 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC<br>ASGPVGKALSDACMGAVASFLTKYQDIILEHQKVIKKNEKRLANLKDIASANGLA<br>FPKITLPPQPHTKEGIEAYNNVVAQIVIWVNLNLWQKLKIGRDEAKPLQRLKGFP<br>SFPPLVERQANEVDWWDMVCNVKKLINEKKEDGKVFWQNLAGYKRQEALRPYLSSE<br>EDRKKGKKFARYQFGDLLLHLEKKHGEDWGKVYDEAWERIDKKVEGLSKHIKLEE<br>ERRSEDAQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIKPEA<br>FEANRFYTVINKKSGEIVPMEVNFNFDDPNLIILPLAFGKRQGREFIWNDLLSLE<br>TGSLKLANGRVIEKTLYNRRTRQDEPALFVALTFERREVLDSSNIKPMNLIGIDR<br>GENIPAVIALTDPEGCPLSRFKDSLGNPTHILRIGESYKEKQRTIQAKKEVEQRR<br>AGGYSRKYASKAKNLADDMVRNTARDLLYYAVTQDAMLIFENLSRGFGRQGKRTF<br>MAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNND<br>ISSWTKGRSGEALSLLKKRFSHRPVQEKFVCLNCGFETHADEQAALNIARSWLFL<br>RSQEYKKYQTNKTTGNTDKRAFVETWQSFYRKKLKEVWKPAVTSPKKKRKVPPPS<br>RRRKANPTKLSENAKKLAKEVEN (SEQ ID NO: 224) |
| 291 | MQEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNIDQ<br>RKLIPVKDGNERLTSSGFACSQCCQPLYVYKLEQVNDKGKPHTNYFGRCNVSEHE<br>RLILLSPHKPEANDELVTYSLGKFGQRALDFYSIHVTRESNHPVKPLEQIGGNSC |

TABLE 8-continued

CasX 278-280, 285-288, 290, 291, 293, 300, 492, and 493 sequences

| Construct | Amino Acid Sequence |
|---|---|
| | ASGPVGKALSDACMGAVASFLTKYQDIILEHQKVIKKNEKRLANLKDIASANGLA
FPKITLPPQPHTKEGIEAYNNVVAQIVIWVNLNLWQKLKIGRDEAKPLQRLKGFP
SFPLVERQANEVDWWDMVCNVKKLINEKKEDGKVFWQNLAGYKRQEALRPYLSSE
EDRKKGKKFARYQFGDLLLHLEKKHGEDWGKVYDEAWERIDKKVEGLSKHIKLEE
ERRSEDAQSKAALTDWLRAKASFVIEGLKEADKDEFCRCELKLQKWYGDLRGKPF
AIEAENSILDISGFSKQYNCAFIWQKDGVKKLNLYLIINYFKGGKLRFKKIKPEA
FEANRFYTVINKKSGEIVPMEVNFNFDDPNLIILPLAFGKRQGREFIWNDLLSLE
TGSLKLANGRVIEKTLYNRRTRQDEPALFVALTFERREVLDSSNIKPMNLIGIDR
GENIPAVIALTDPEGCPLSRFKDSLGNPTHILRIGESYKEKQRTIQAKKEVEQRR
AGGYSRKYASKAKNLADDMVRNTARDLLYYAVTQDAMLIFENLSRGFGRQGKRTF
MAERQYTRMEDWLTAKLAYEGLSKTYLSKTLAQYTSKTCSNCGFTITSADYDRVL
EKLKKTATGWMTTINGKELKVEGQITYYNRYKRQNVVKDLSVELDRLSEESVNND
ISSWTKGRSGEALSLLKKRFSHRPVQEKFVCLNCGFETHADEQAALNIARSWLFL
RSQEYKKYQTNKTTGNTDKRAFVETWQSFYRKKLKEVWKPAVTSPKKKRKVPPPP
AAKRVKLD (SEQ ID NO: 225) |
| 293 | MQEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPAPKNIDQ
RKLIPVKDGNERLTSSGFACSQCCQPLYVYKLEQVNDKGKPHTNYFGRCNVSEHE
RLILLSPHKPEANDELVTYSLGKFGQRALDFYSIHVTRESNHPVKPLEQIGGNSC
ASGPVGKALSDACMGAVASFLTKYQDIILEHQKVIKKNEKRLANLKDIASANGLA
FPKITLPPQPHTKEGIEAYNNVVAQIVIWVNLNLWQKLKIGRDEAKPLQRLKGFP
SFPLVERQANEVDWWDMVCNVKKLINEKKEDGKVFWQNLAGYKRQEALRPYLSSE
EDRKKGKKFARYQFGDLLLHLEKKHGEDWGKVYDEAWERIDKKVEGLSKHIKLEE
ERRSEDAQSKAALTDWLRAKASFVIEGLKEADKDEFCRCELKLQKWYGDLRGKPF
AIEAENSILDISGFSKQYNCAFIWQKDGVKKLNLYLIINYFKGGKLRFKKIKPEA
FEANRFYTVINKKSGEIVPMEVNFNFDDPNLIILPLAFGKRQGREFIWNDLLSLE
TGSLKLANGRVIEKTLYNRRTRQDEPALFVALTFERREVLDSSNIKPMNLIGIDR
GENIPAVIALTDPEGCPLSRFKDSLGNPTHILRIGESYKEKQRTIQAKKEVEQRR
AGGYSRKYASKAKNLADDMVRNTARDLLYYAVTQDAMLIFENLSRGFGRQGKRTF
MAERQYTRMEDWLTAKLAYEGLSKTYLSKTLAQYTSKTCSNCGFTITSADYDRVL
EKLKKTATGWMTTINGKELKVEGQITYYNRYKRQNVVKDLSVELDRLSEESVNND
ISSWTKGRSGEALSLLKKRFSHRPVQEKFVCLNCGFETHADEQAALNIARSWLFL
RSQEYKKYQTNKTTGNTDKRAFVETWQSFYRKKLKEVWKPAVTSPKKKRKVPPPK
RSFSKAF (SEQ ID NO: 226) |
| 300 | MQEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPAPKNIDQ
RKLIPVKDGNERLTSSGFACSQCCQPLYVYKLEQVNDKGKPHTNYFGRCNVSEHE
RLILLSPHKPEANDELVTYSLGKFGQRALDFYSIHVTRESNHPVKPLEQIGGNSC
ASGPVGKALSDACMGAVASFLTKYQDIILEHQKVIKKNEKRLANLKDIASANGLA
FPKITLPPQPHTKEGIEAYNNVVAQIVIWVNLNLWQKLKIGRDEAKPLQRLKGFP
SFPLVERQANEVDWWDMVCNVKKLINEKKEDGKVFWQNLAGYKRQEALRPYLSSE
EDRKKGKKFARYQFGDLLLHLEKKHGEDWGKVYDEAWERIDKKVEGLSKHIKLEE
ERRSEDAQSKAALTDWLRAKASFVIEGLKEADKDEFCRCELKLQKWYGDLRGKPF
AIEAENSILDISGFSKQYNCAFIWQKDGVKKLNLYLIINYFKGGKLRFKKIKPEA
FEANRFYTVINKKSGEIVPMEVNFNFDDPNLIILPLAFGKRQGREFIWNDLLSLE
TGSLKLANGRVIEKTLYNRRTRQDEPALFVALTFERREVLDSSNIKPMNLIGIDR
GENIPAVIALTDPEGCPLSRFKDSLGNPTHILRIGESYKEKQRTIQAKKEVEQRR
AGGYSRKYASKAKNLADDMVRNTARDLLYYAVTQDAMLIFENLSRGFGRQGKRTF
MAERQYTRMEDWLTAKLAYEGLSKTYLSKTLAQYTSKTCSNCGFTITSADYDRVL
EKLKKTATGWMTTINGKELKVEGQITYYNRYKRQNVVKDLSVELDRLSEESVNND
ISSWTKGRSGEALSLLKKRFSHRPVQEKFVCLNCGFETHADEQAALNIARSWLFL
RSQEYKKYQTNKTTGNTDKRAFVETWQSFYRKKLKEVWKPAVTSPKKKRKVPPPK
RGINDRNFWRGENERKTR (SEQ ID NO: 227) |
| 492 | MAPKKKRKVSRMQEIKRINKIRRRLVKDSNTKKAGKTGPMKTLLVRVMTPDLRER
LENLRKKPENIPQPISNTSRANLNKLLTDYTEMKKAILHVYWEEFQKDPVGLMSR
VAQPAPKNIDQRKLIPVKDGNERLTSSGFACSQCCQPLYVYKLEQVNDKGKPHTN
YFGRCNVSEHERLILLSPHKPEANDELVTYSLGKFGQRALDFYSIHVTRESNHPV
KPLEQIGGNSCASGPVGKALSDACMGAVASFLTKYQDIILEHQKVIKKNEKRLAN
LKDIASANGLAFPKITLPPQPHTKEGIEAYNNVVAQIVIWVNLNLWQKLKIGRDE
AKPLQRLKGFPSFPLVERQANEVDWWDMVCNVKKLINEKKEDGKVFWQNLAGYKR
QEALRPYLSSEEDRKKGKKFARYQFGDLLLHLEKKHGEDWGKVYDEAWERIDKKV
EGLSKHIKLEEERRSEDAQSKAALTDWLRAKASFVIEGLKEADKDEFCRCELKLQ
KWYGDLRGKPFAIEAENSILDISGFSKQYNCAFIWQKDGVKKLNLYLIINYFKGG
KLRFKKIKPEAFEANRFYTVINKKSGEIVPMEVNFNFDDPNLIILPLAFGKRQGR
EFIWNDLLSLETGSLKLANGRVIEKTLYNRRTRQDEPALFVALTFERREVLDSSN
IKPMNLIGIDRGENIPAVIALTDPEGCPLSRFKDSLGNPTHILRIGESYKEKQRT
IQAKKEVEQRRAGGYSRKYASKAKNLADDMVRNTARDLLYYAVTQDAMLIFENLS
RGFGRQGKRTFMAERQYTRMEDWLTAKLAYEGLSKTYLSKTLAQYTSKTCSNCGF
TITSADYDRVLEKLKKTATGWMTTINGKELKVEGQITYYNRYKRQNVVKDLSVEL
DRLSEESVNNDISSWTKGRSGEALSLLKKRFSHRPVQEKFVCLNCGFETHADEQA
ALNIARSWLFLRSQEYKKYQTNKTTGNTDKRAFVETWQSFYRKKLKEVWKPAVTS
PKKKRKVPPPPKKKRKV (SEQ ID NO: 228) |

TABLE 8-continued

CasX 278-280, 285-288, 290, 291, 293, 300, 492, and 493 sequences

| Construct | Amino Acid Sequence |
|---|---|
| 493 | MAPKKKRKVSRMQEIKRINKIRRRLVKDSNTKKAGKTGPMKTLLVRVMTPDLRER LENLRKKPENIPQPISNTSRANLNKLLTDYTEMKKAILHVYWEEFQKDPVGLMSR VAQPAPKNIDQRKLIPVKDGNERLTSSGFACSQCCQPLYVYKLEQVNDKGKPHTN YFGRCNVSEHERLILLSPHKPEANDELVTYSLGKFGQRALDFYSIHVTRESNHPV KPLEQIGGNSCASGPVGKALSDACMGAVASFLTKYQDIILEHQKVIKKNEKRLAN LKDIASANGLAFPKITLPPQPHTKEGIEAYNNVVAQIVIWVNLNLWQKLKIGRDE AKPLQRLKGFPSFPLVERQANEVDWWDMVCNVKKLINEKKEDGKVFWQNLAGYKR QEALRPYLSSEEDRKKGKKFARYQFGDLLLHLEKKHGEDWGKVYDEAWERIDKKV EGLSKHIKLEEERRSEDAQSKAALTDWLRAKASFVIEGLKEADKDEFCRCELKLQ KWYGDLRGKPFAIEAENSILDISGFSKQYNCAFIWQKDGVKKLNLYLIINYFKGG KLRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSSN IKPMNLIGIDRGENIPAVIALTDPEGCPLSRFKDSLGNPTHILRIGESYKEKQRT IQAKKEVEQRRAGGYSRKYASKAKNLADDMVRNTARDLLYYAVTQDAMLIFENLS RGFGRQGKRTFMAERQYTRMEDWLTAKLAYEGLSKTYLSKTLAQYTSKTCSNCGF TITSADYDRVLEKLKKTATGWMTTINGKELKVEGQITYYNRYKRQNVVKDLSVEL DRLSEESVNNDISSWTKGRSGEALSLLKKRFSHRPVQEKFVCLNCGFETHADEQA ALNIARSWLFLRSQEYKKYQTNKTTGNTDKRAFVETWQSFYRKKLKEVWKPAVTS PKKKRKVPPPPAAKRVKLD (SEQ ID NO: 229) |

TABLE 9

Nuclear localization sequence list

| CasX | NLS | DNA Sequence | Amino Acid Sequence |
|---|---|---|---|
| 278, 279, 280, 492, 493 | SV40 | CCAAAGAAGAAGCGGAAGGTC (SEQ ID NO: 230) | PKKKRKV (SEQ ID NO: 145) |
| 285 | SynthNLS3 | CACAAGAAGAAACATCCAGACGC ATCAGTCAACTTTAGCGAGTTCA GTAAA (SEQ ID NO: 231) | HKKKHPDASVNFSEFSK (SEQ ID NO: 176) |
| 286 | SynthNLS4 | CAGCGCCCTGGGCCTTACGATAG GCCGCAAAGACCCGGACCGTATG ATCGCCCT (SEQ ID NO: 232) | QRPGPYDRPQRPGPYDRP (SEQ ID NO: 177) |
| 287 | SynthNLS5 | CTCAGCCCGAGTCTTAGTCCACT GCTTTCCCCGTCCCTGTCTCCAC TG (SEQ ID NO: 233) | LSPSLSPLLSPSLSPL (SEQ ID NO: 178) |
| 288 | SynthNLS6 | CGGGGCAAGGGTGGCAAGGGGCT TGGCAAGGGGGGGCAAAGAGGC ACAGGAAG (SEQ ID NO: 234) | RGKGGKGLGKGGAKRHRK (SEQ ID NO: 179) |
| 290 | EGL-13 | AGCCGCCGCAGAAAAGCCAATCC TACAAAACTGTCAGAAAATGCGA AAAAACTTGCTAAGGAGGTGGAA AAC (SEQ ID NO: 235) | SRRRKANPTKLSENAKKLA KEVEN (SEQ ID NO: 172) |
| 291 | c-Myc | CCTGCCGCAAAGCGAGTGAAATT GGAC (SEQ ID NO: 236) | PAAKRVKLD (SEQ ID NO: 147) |
| 293 | Nucleolar RNA Helicase II | AAGCGGTCCTTCAGTAAGGCCTT T (SEQ ID NO: 237) | KRSFSKAF (SEQ ID NO: 168) |
| 300 | Influenza A protein | AAACGGGGAATAAACGACCGGAA CTTCTGGCGCGGGGAAAACGAGC GCAAAACCCGA (SEQ ID NO: 238) | KRGINDRNFWRGENEPKTR (SEQ ID NO: 166) |

Example 5: Design and Generation of CasX Constructs 387, 395, 485-491, and 494

In order to generate CasX 395, CasX 485, CasX 486, CasX 487, the codon optimized CasX 119 (based on the CasX 37 construct of Example 2, encoding *Planctomycetes* CasX SEQ ID NO: 2, with a A708K substitution and a [P793] deletion with fused NLS, and linked guide and non-targeting sequences), CasX 435, CasX 438, and CasX 484 (each based on CasX 119 construct of Example 2 encoding *Planctomycetes* CasX SEQ ID NO: 2, with a L379R substitution, a A708K substitution, and a [P793]

deletion with fused NLS, and linked guide and non-targeting sequences) were cloned respectively into a 4 kb staging vector comprising a KdnR marker, colE1 ori, and CasX with fused NLS (pStx1) using standard cloning methods. Gibson primers were designed to amplify the CasX SEQ ID NO: 1 Helical I domain from amino acid 192-331 in its own vector to replace this corresponding region (aa 193-332) on CasX 119, CasX 435, CasX 438, and CasX 484 in pStx1 respectively. The Helical I domain from CasX SEQ ID NO: 1 was amplified with primers oIC768 and oIC784 using Q5 DNA polymerase (New England BioLabs Cat #M0491L) according to the manufacturer's protocol. The destination vector containing the desired CasX variant was amplified with primers oIC765 and oIC764 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson assembly® (New England BioLabs Cat #E2621S) following the manufacturer's protocol. Assembled products in the pStx1 staging vector were transformed into chemically-competent Turbo Competent E. coli bacterial cells, plated on LB-Agar plates (LB: Teknova Cat #L9315, Agar: Quartzy Cat #214510) containing kanamycin and incubated at 37° C. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly.

Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent E. coli (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct ligation.

In order to generate CasX 488, CasX 489, CasX 490, and CasX 491 (sequences in Table 10), the codon optimized CasX 119 (based on the CasX 37 construct of Example 2, encoding *Planctomycetes* CasX SEQ ID NO: 2, with a A708K substitution and a [P793] deletion with fused NLS, and linked guide and non-targeting sequences), CasX 435, CasX 438, and CasX 484 (each based on CasX119 construct of Example 2 encoding *Planctomycetes* CasX SEQ ID NO: 2, with a L379R substitution, a A708K substitution, and a [P793] deletion with fused NLS, and linked guide and non-targeting sequences) were cloned respectively into a 4 kb staging vector that was made up of a KdnR marker, colE1 ori, and STX with fused NLS (pStx1) using standard cloning methods. Gibson primers were designed to amplify the CasX Stx1 NTSB domain from amino acid 101-191 and Helical I domain from amino acid 192-331 in its own vector to replace this similar region (aa 103-332) on CasX 119, CasX 435, CasX 438, and CasX 484 in pStx1 respectively. The NTSB and Helical I domain from CasX SEQ ID NO: 1 were amplified with primers oIC766 and oIC784 using Q5 DNA polymerase (New England BioLabs Cat #M0491L) according to the manufacturer's protocol. The destination vector containing the desired CasX variant was amplified with primers oIC762 and oIC765 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson assembly® (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen QIAprep® Spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen QIAprep® Spin Miniprep Kit (Qiagen Cat #27104) and following the manufacturer's protocol. The resultant plasmids were sequenced using Sanger sequencing to ensure correct ligation.

In order to generate CasX 387 and CasX 494 (sequences in Table 10), the codon optimized CasX 119 (based on the CasX 37 construct of Example 2, encoding *Planctomycetes* CasX SEQ ID NO: 2, with a A708K substitution and a [P793] deletion with fused NLS, and linked guide and non-targeting sequences) and CasX 484 (based on CasX119 construct of Example 2 encoding *Planctomycetes* CasX SEQ ID NO: 2, with a L379R substitution, a A708K substitution, and a [P793] deletion with fused NLS, and linked guide and non-targeting sequences) were cloned respectively into a 4 kb staging vector that was made up of a KdnR marker, colE1 ori, and STX with fused NLS (pStx1) using standard cloning methods. Gibson primers were designed to amplify the CasX Stx1 NTSB domain from amino acid 101-191 in its own vector to replace this similar region (aa 103-192) on CasX 119 and CasX 484 in pStx1 respectively. The NTSB domain from CasX Stx1 was amplified with primers oIC766 and oIC767 using Q5 DNA polymerase (New England BioLabs Cat #M0491L) according to the manufacturer's protocol. The destination vector containing the desired CasX variant was amplified with primers oIC763 and oIC762 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean™ Gel DNA Recovery Kit (Zymo Research Cat #D4002) according to the manufacturer's protocol. The insert and backbone fragments were then pieced together using Gibson assembly® (New England BioLabs Cat #E2621S) following the manufacturer's protocol. Assembled products in the pStx1 staging vector were transformed into chemically-competent Turbo Competent E. coli bacterial cells, plated on LB-Agar plates (LB: Teknova Cat #L9315, Agar: Quartzy Cat #214510) containing kanamycin and incubated at 37° C. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) and following the manufacturer's protocol. The resultant plasmids were sequenced using Sanger sequencing to ensure correct ligation. Sequences of the resulting constructs are listed in Table 10.

TABLE 10

Sequences of CasX 395 and 485-491

| Construct | DNA Sequence | Amino Acid Sequence |
|---|---|---|
| CasX 387 | (SEQ ID NO: 239) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPASKKIDQNKLKPEMDEKGNLTTAGFACS QCGQPLFVYKLEQVSEKGKAYTNYFGRCNVAEHEKLILLAQLKPEKD SDEAVTYSLGKFGQRALDFYSIHVTRESNHPVKPLEQIGGNSCASGP VGKALSDACMGAVASFLTKYQDIILEHQKVIKKNEKRLANLKDIASA NGLAFPKITLPPQPHTKEGIEAYNNVVAQIVIWVNLNLWQKLKIGRD EAKPLQRLKGFPSFPLVERQANEVDWWDMVCNVKKLINEKKEDGKVF WQNLAGYKRQEALRPYLSSEEDRKKGKKFARYQFGDLLLHLEKKHGE DWGKVYDEAWERIDKKVEGLSKHIKLEEERRSEDAQSKAALTDWLRA KASFVIEGLKEADKDEFCRCELKLQKWYGDLRGKPFAIEAENSILDI SGFSKQYNCAFIWQKDGVKKLNLYLIINYFKGGKLRFKKIKPEAFEA NRFYTVINKKSGEIVPMEVNFNFDDPNLIILPLAFGKRQGREFIWND LLSLETGSLKLANGRVIEKTLYNRRTRQDEPALFVALTFERREVLDS SNIKPMNLIGIDRGENIPAVIALTDPEGCPLSRFKDSLGNPTHILRI GESYKEKQRTIQAKKEVEQRRAGGYSRKYASKAKNLADDMVRNTARD LLYYAVTQDAMLIFENLSRGFGRQGKRTFMAERQYTRMEDWLTAKLA YEGLSKTYLSKTLAQYTSKTCSNCGFTITSADYDRVLEKLKKTATGW MTTINGKELKVEGQITYYNRYKRQNVVKDLSVELDRLSEESVNNDIS SWTKGRSGEALSLLKKRFSHRPVQEKFVCLNCGFETHADEQAALNIA RSWLFLRSQEYKKYQTNKTTGNTDKRAFVETWQSFYRKKLKEVWKPA VTSPKKKRKV (SEQ ID NO: 240) |
| CasX 395 | (SEQ ID NO: 241) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPAPKNIDQRKLIPVKDGNERLTSSGFACS QCCQPLYVYKLEQVNDKGKPHTNYFGRCNVSEHERLILLSPHKPEAN DELVTYSLGKFGQRALDFYSIHVTKESTHPVKPLAQIAGNRYASGPV GKALSDACMGTIASFLSKYQDIIIEHQKVVKGNQKRLESLRELAGKE NLEYPSVTLPPQPHTKEGVDAYNEVIARVRMWVNLNLWQKLKLSRDD AKPLLRLKGFPSFPLVERQANEVDWWDMVCNVKKLINEKKEDGKVFW QNLAGYKRQEALRPYLSSEEDRKKGKKFARYQFGDLLLHLEKKHGED WGKVYDEAWERIDKKVEGLSKHIKLEEERRSEDAQSKAALTDWLRAK ASFVIEGLKEADKDEFCRCELKLQKWYGDLRGKPFAIEAENSILDIS GFSKQYNCAFIWQKDGVKKLNLYLIINYFKGGKLRFKKIKPEAFEAN RFYTVINKKSGEIVPMEVNFNFDDPNLIILPLAFGKRQGREFIWNDL LSLETGSLKLANGRVIEKTLYNRRTRQDEPALFVALTFERREVLDSS NIKPMNLIGIDRGENIPAVIALTDPEGCPLSRFKDSLGNPTHILRIG ESYKEKQRTIQAKKEVEQRRAGGYSRKYASKAKNLADDMVRNTARDL LYYAVTQDAMLIFENLSRGFGRQGKRTFMAERQYTRMEDWLTAKLAY EGLSKTYLSKTLAQYTSKTCSNCGFTITSADYDRVLEKLKKTATGWM TTINGKELKVEGQITYYNRYKRQNVVKDLSVELDRLSEESVNNDISS WTKGRSGEALSLLKKRFSHRPVQEKFVCLNCGFETHADEQAALNIAR SWLFLRSQEYKKYQTNKTTGNTDKRAFVETWQSFYRKKLKEVWKPAV TSPKKKRKVTSPKKKRKV (SEQ ID NO: 242) |

TABLE 10-continued Sequences of CasX 395 and 485-491

| Construct | DNA Sequence | Amino Acid Sequence |
| --- | --- | --- |
| CasX 485 | (SEQ ID NO: 243) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPAPKNIDQRKLIPVKDGNERLTSSGFACS QCCQPLYVYKLEQVNDKGKPHTNYFGRCNVSEHERLILLSPHKPEAN DELVTYSLGKFGQRALDFYSIHVTKESTHPVKPLAQIAGNRYASGPV GKALSDACMGTIASFLSKYQDIIIEHQKVVKGNQKRLESLRELAGKE NLEYPSVTLPPQPHTKEGVDAYNEVIARVRMWVNLNLWQKLKLSRDD AKPLLRLKGFPSFPLVERQANEVDWWDMVCNVKKLINEKKEDGKVFW QNLAGYKRQEALRPYLSSEEDRKKGKKFARYQLGDLLLHLEKKHGED WGKVYDEAWERIDKKVEGLSKHIKLEEERRSEDAQSKAALTDWLRAK ASFVIEGLKEADKDEFCRCELKLQKWYGDLRGKPFAIEAENSILDIS GFSKQYNCAFIWQKDGVKKLNLYLIINYFKGGKLRFKKIKPEAFEAN RFYTVINKKSGEIVPMEVNFNFDDPNLIILPLAFGKRQGREFIWNDL LSLETGSLKLANGRVIEKTLYNRRTRQDEPALFVALTFERREVLDSS NIKPMNLIGVDRGENIPAVIALTDPEGCPLSRFKDSLGNPTHILRIG ESYKEKQRTIQAKKEVEQRRAGGYSRKYASKAKNLADDMVRNTARDL LYYAVTQDAMLIFENLSRGFGRQGKRTFMAERQYTRMEDWLTAKLAY EGLSKTYLSKTLAQYTSKTCSNCGFTITSADYDRVLEKLKKTATGWM TTINGKELKVEGQITYYNRRKRQNVVKDLSVELDRLSEESVNNDISS WTKGRSGEALSLLKKRFSHRPVQEKFVCLNCGFETHADEQAALNIAR SWLFLRSQEYKKYQTNKTTGNTDKRAFVETWQSFYRKKLKEVWKPAV TSPKKKRKV (SEQ ID NO: 244) |
| CasX 486 | (SEQ ID NO: 245) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPAPKNIDQRKLIPVKDGNERLTSSGFACS QCCQPLYVYKLEQVNDKGKPHTNYFGRCNVSEHERLILLSPHKPEAN DELVTYSLGKFGQRALDFYSIHVTKESTHPVKPLAQIAGNRYASGPV GKALSDACMGTIASFLSKYQDIIIEHQKVVKGNQKRLESLRELAGKE NLEYPSVTLPPQPHTKEGVDAYNEVIARVRMWVNLNLWQKLKLSRDD AKPLLRLKGFPSFPLVERQANEVDWWDMVCNVKKLINEKKEDGKVFW QNLAGYKRQEALRPYLSSEEDRKKGKKFARYQLGDLLHLEKKHGED WGKVYDEAWERIDKKVEGLSKHIKLEEERRSEDAQSKAALTDWLRAK ASFVIEGLKEADKDEFCRCELKLQKWYGDLRGKPFAIEAENSILDIS GFSKQYNCAFIWQKDGVKKLNLYLIINYFKGGKLRFKKIKPEAFEAN RFYTVINKKSGEIVPMEVNFNFDDPNLIILPLAFGKRQGREFIWNDL LSLETGSLKLANGRVIEKTLYNRRTRQDEPALFVALTFERREVLDSS NIKPMNLIGVDRGENIPAVIALTDPEGCPLSRFKDSLGNPTHILRIG ESYKEKQRTIQAKKEVEQRRAGGYSRKYASKAKNLADDMVRNTARDL LYYAVTQDAMLIFENLSRGFGRQGKRTFMAERQYTRMEDWLTAKLAY EGLSKTYLSKTLAQYTSKTCSNCGFTITSADYDRVLEKLKKTATGWM TTINGKELKVEGQITYYNRRKRQNVVKDLSVELDRLSEESVNNDISS WTKGRSGEALSLLKKRFSHRPVQEKFVCLNCGFETHADEQAALNIAR SWLFLRSQEYKKYQTNKTTGNTDKRAFVETWQSFYRKKLKEVWKPAV TSPKKKRKV (SEQ ID NO: 246) |
| CasX 487 | (SEQ ID NO: 247) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPAPKNIDQRKLIPVKDGNERLTSSGFACS QCCQPLYVYKLEQVNDKGKPHTNYFGRCNVSEHERLILLSPHKPEAN DELVTYSLGKFGQRALDFYSIHVTKESTHPVKPLAQIAGNRYASGPV GKALSDACMGTIASFLSKYQDIIIEHQKVVKGNQKRLESLRELAGKE NLEYPSVTLPPQPHTKEGVDAYNEVIARVRMWVNLNLWQKLKLSRDD AKPLLRLKGFPSFPLVERQANEVDWWDMVCNVKKLINEKKEDGKVFW QNLAGYKRQEALRPYLSSEEDRKKGKKFARYQLGDLLLHLEKKHGED WGKVYDEAWERIDKKVEGLSKHIKLEEERRSEDAQSKAALTDWLRAK ASFVIEGLKEADKDEFCRCELKLQKWYGDLRGKPFAIEAENSILDIS GFSKQYNCAFIWQKDGVKKLNLYLIINYFKGGKLRFKKIKPEAFEAN RFYTVINKKSGEIVPMEVNFNFDDPNLIILPLAFGKRQGREFIWNDL LSLETGSLKLANGRVIEKTLYNRRTRQDEPALFVALTFERREVLDSS NIKPMNLIGVDRGENIPAVIALTDPEGCPLSRFKDSLGNPTHILRIG ESYKEKQRTIQAKKEVEQRRAGGYSRKYASKAKNLADDMVRNTARDL LYYAVTQDAMLIFENLSRGFGRQGKRTFMAERQYTRMEDWLTAKLAY EGLSKTYLSKTLAQYTSKTCSNCGFTITSADYDRVLEKLKKTATGWM TTINGKELKVEGQITYYNRYKRQNVVKDLSVELDRLSEESVNNDISS WTKGRSGEALSLLKKRFSHRPVQEKFVCLNCGFETHADEQAALNIAR SWLFLRSQEYKKYQTNKTTGNTDKRAFVETWQSFYRKKLKEVWKPAV TSPKKKRKV (SEQ ID NO: 248) |
| CasX 488 | (SEQ ID NO: 249) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPASKKIDQNKLKPEMDEKGNLTTAGFACS QCGQPLFVYKLEQVSEKGKAYTNYFGRCNVAEHEKLILLAQLKPEKD SDEAVTYSLGKFGQRALDFYSIHVTKESTHPVKPLAQIAGNRYASGP VGKALSDACMGTIASFLSKYQDIIIEHQKVVKGNQKRLESLRELAGK ENLEYPSVTLPPQPHTKEGVDAYNEVIARVRMWVNLNLWQKLKLSRD |

TABLE 10-continued

Sequences of CasX 395 and 485-491

| Construct | DNA Sequence | Amino Acid Sequence |
|---|---|---|
| | | DAKPLLRLKGFPSFPLVERQANEVDWWDMVCNVKKLINEKKEDGKVF<br>WQNLAGYKRQEALRPYLSSEEDRKKGKKFARYQFGDLLLHLEKKHGE<br>DWGKVYDEAWERIDKKVEGLSKHIKLEEERRSEDAQSKAALTDWLRA<br>KASFVIEGLKEADKDEFCRCELKLQKWYGDLRGKPFAIEAENSILDI<br>SGFSKQYNCAFIWQKDGVKKLNLYLIINYFKGGKLRFKKIKPEAFEA<br>NRFYTVINKKSGEIVPMEVNFNFDDPNLIILPLAFGKRQGREFIWND<br>LLSLETGSLKLANGRVIEKTLYNRRTRQDEPALFVALTFERREVLDS<br>SNIKPMNLIGIDRGENIPAVIALTDPEGCPLSRFKDSLGNPTHILRI<br>GESYKEKQRTIQAKKEVEQRRAGGYSRKYASKAKNLADDMVRNTARD<br>LLYYAVTQDAMLIFENLSRGFGRQGKRTFMAERQYTRMEDWLTAKLA<br>YEGLSKTYLSKTLAQYTSKTCSNCGFTITSADYDRVLEKLKKTATGW<br>MTTINGKELKVEGQITYYNRYKRQNVVKDLSVELDRLSEESVNNDIS<br>SWTKGRSGEALSLLKKRFSHRPVQEKFVCLNCGFETHADEQAALNIA<br>RSWLFLRSQEYKKYQTNKTTGNTDKRAFVETWQSFYRKKLKEVWKPA<br>VTSPKKKRKV (SEQ ID NO: 250) |
| CasX 489 | (SEQ ID NO: 251) | MAPKKKRKVSRQEIKRINKIRRRLVKDSNTKKAGKTGPMKTLLVRVM<br>TPDLRERLENLRKKPENIPQPISNTSRANLNKLLTDYTEMKKAILHV<br>YWEEFQKDPVGLMSRVAQPASKKIDQNKLKPEMDEKGNLTTAGFACS<br>QCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGP<br>VGKALSDACMGTIASFLSKYQDIIIEHQKVVKGNQKRLESLRELAGK<br>ENLEYPSVTLPPQPHTKEGVDAYNEVIARVRMWVNLNLWQKLKLSRD<br>DAKPLLRLKGFPSFPLVERQANEVDWWDMVCNVKKLINEKKEDGKVF<br>WQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRA<br>KASFVIEGLKEADKDEFCRCELKLQKWYGDLRGKPFAIEAENSILDI<br>SGFSKQYNCAFIWQKDGVKKLNLYLIINYFKGGKLRFKKIKPEAFEA<br>NRFYTVINKKSGEIVPMEVNFNFDDPNLIILPLAFGKRQGREFIWND<br>LLSLETGSLKLANGRVIEKTLYNRRTRQDEPALFVALTFERREVLDS<br>SNIKPMNLIGVDRGENIPAVIALTDPEGCPLSRFKDSLGNPTHILRI<br>GESYKEKQRTIQAKKEVEQRRAGGYSRKYASKAKNLADDMVRNTARD<br>LLYYAVTQDAMLIFENLSRGFGRQGKRTFMAERQYTRMEDWLTAKLA<br>YEGLSKTYLSKTLAQYTSKTCSNCGFTITSADYDRVLEKLKKTATGW<br>MTTINGKELKVEGQITYYNRRKRQNVVKDLSVELDRLSEESVNNDIS<br>SWTKGRSGEALSLLKKRFSHRPVQEKFVCLNCGFETHADEQAALNIA<br>RSWLFLRSQEYKKYQTNKTTGNTDKRAFVETWQSFYRKKLKEVWKPA<br>VTSPKKKRKV (SEQ ID NO: 252) |
| CasX 490 | (SEQ ID NO: 253) | MAPKKKRKVSRQEIKRINKIRRRLVKDSNTKKAGKTGPMKTLLVRVM<br>TPDLRERLENLRKKPENIPQPISNTSRANLNKLLTDYTEMKKAILHV<br>YWEEFQKDPVGLMSRVAQPASKKIDQNKLKPEMDEKGNLTTAGFACS<br>QCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGP<br>VGKALSDACMGTIASFLSKYQDIIIEHQKVVKGNQKRLESLRELAGK<br>ENLEYPSVTLPPQPHTKEGVDAYNEVIARVRMWVNLNLWQKLKLSRD<br>DAKPLLRLKGFPSFPLVERQANEVDWWDMVCNVKKLINEKKEDGKVF<br>WQNLAGYKRQEALRPYLSSEEDRKKGKKFARYQLGDLLKHLEKKHGE<br>DWGKVYDEAWERIDKKVEGLSKHIKLEEERRSEDAQSKAALTDWLRA<br>KASFVIEGLKEADKDEFCRCELKLQKWYGDLRGKPFAIEAENSILDI<br>SGFSKQYNCAFIWQKDGVKKLNLYLIINYFKGGKLRFKKIKPEAFEA<br>NRFYTVINKKSGEIVPMEVNFNFDDPNLIILPLAFGKRQGREFIWND<br>LLSLETGSLKLANGRVIEKTLYNRRTRQDEPALFVALTFERREVLDS<br>SNIKPMNLIGVDRGENIPAVIALTDPEGCPLSRFKDSLGNPTHILRI<br>GESYKEKQRTIQAKKEVEQRRAGGYSRKYASKAKNLADDMVRNTARD<br>LLYYAVTQDAMLIFENLSRGFGRQGKRTFMAERQYTRMEDWLTAKLA<br>YEGLSKTYLSKTLAQYTSKTCSNCGFTITSADYDRVLEKLKKTATGW<br>MTTINGKELKVEGQITYYNRRKRQNVVKDLSVELDRLSEESVNNDIS<br>SWTKGRSGEALSLLKKRFSHRPVQEKFVCLNCGFETHADEQAALNIA<br>RSWLFLRSQEYKKYQTNKTTGNTDKRAFVETWQSFYRKKLKEVWKPA<br>VTSPKKKRKV (SEQ ID NO: 254) |
| CasX 491 | (SEQ ID NO: 255) | MAPKKKRKVSRQEIKRINKIRRRLVKDSNTKKAGKTGPMKTLLVRVM<br>TPDLRERLENLRKKPENIPQPISNTSRANLNKLLTDYTEMKKAILHV<br>YWEEFQKDPVGLMSRVAQPASKKIDQNKLKPEMDEKGNLTTAGFACS<br>QCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGP<br>VGKALSDACMGTIASFLSKYQDIIIEHQKVVKGNQKRLESLRELAGK<br>ENLEYPSVTLPPQPHTKEGVDAYNEVIARVRMWVNLNLWQKLKLSRD<br>DAKPLLRLKGFPSFPLVERQANEVDWWDMVCNVKKLINEKKEDGKVF<br>WQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRA<br>KASFVIEGLKEADKDEFCRCELKLQKWYGDLRGKPFAIEAENSILDI<br>SGFSKQYNCAFIWQKDGVKKLNLYLIINYFKGGKLRFKKIKPEAFEA<br>NRFYTVINKKSGEIVPMEVNFNFDDPNLIILPLAFGKRQGREFIWND<br>LLSLETGSLKLANGRVIEKTLYNRRTRQDEPALFVALTFERREVLDS |

TABLE 10-continued

Sequences of CasX 395 and 485-491

| Construct | DNA Sequence | Amino Acid Sequence |
|---|---|---|
| | | SNIKPMNLIGVDRGENIPAVIALTDPEGCPLSRFKDSLGNPTHILRI GESYKEKQRTIQAKKEVEQRRAGGYSRKYASKAKNLADDMVRNTARD LLYYAVTQDAMLIFENLSRGFGRQGKRTFMAERQYTRMEDWLTAKLA YEGLSKTYLSKTLAQYTSKTCSNCGFTITSADYDRVLEKLKKTATGW MTTINGKELKVEGQITYYNRYKRQNVVKDLSVELDRLSEESVNNDIS SWTKGRSGEALSLLKKRFSHRPVQEKFVCLNCGFETHADEQAALNIA RSWLFLRSQEYKKYQTNKTTGNTDKRAFVETWQSFYRKKLKEVWKPA VTSPKKKRKV (SEQ ID NO: 256) |
| CasX 494 | (SEQ ID NO: 257) | MAPKKKRKVSRQEIKRINKIRRRLVKDSNTKKAGKTGPMKTLLVRVM TPDLRERLENLRKKPENIPQPISNTSRANLNKLLTDYTEMKKAILHV YWEEFQKDPVGLMSRVAQPASKKIDQNKLKPEMDEKGNLTTAGFACS QCGQPLFVYKLEQVSEKGKAYTNYFGRCNVAEHEKLILLAQLKPEKD SDEAVTYSLGKFGQRALDFYSIHVTRESNHPVKPLEQIGGNSCASGP VGKALSDACMGAVASFLTKYQDIILEHQKVIKKNEKRLANLKDIASA NGLAFPKITLPPQPHTKEGIEAYNNVVAQIVIWVNLNLWQKLKIGRD EAKPLQRLKGFPSFPLVERQANEVDWWDMVCNVKKLINEKKEDGKVF WQNLAGYKRQEALRPYLSSEEDRKKGKKFARYQLGDLLLHLEKKHGE DWGKVYDEAWERIDKKVEGLSKHIKLEEERRSEDAQSKAALTDWLRA KASFVIEGLKEADKDEFCRCELKLQKWYGDLRGKPFAIEAENSILDI SGFSKQYNCAFIWQKDGVKKLNLYLIINYFKGGKLRFKKIKPEAFEA NRFYTVINKKSGEIVPMEVNFNFDDPNLIILPLAFGKRQGREFIWND LLSLETGSLKLANGRVIEKTLYNRRTRQDEPALFVALTFERREVLDS SNIKPMNLIGVDRGENIPAVIALTDPEGCPLSRFKDSLGNPTHILRI GESYKEKQRTIQAKKEVEQRRAGGYSRKYASKAKNLADDMVRNTARD LLYYAVTQDAMLIFENLSRGFGRQGKRTFMAERQYTRMEDWLTAKLA YEGLSKTYLSKTLAQYTSKTCSNCGFTITSADYDRVLEKLKKTATGW MTTINGKELKVEGQITYYNRYKRQNVVKDLSVELDRLSEESVNNDIS SWTKGRSGEALSLLKKRFSHRPVQEKFVCLNCGFETHADEQAALNIA RSWLFLRSQEYKKYQTNKTTGNTDKRAFVETWQSFYRKKLKEVWKPA VTSPKKKRKV (SEQ ID NO: 258) |

Example 6: Generation of RNA Guides

For the generation of RNA single guides and spacers, templates for in vitro transcription were generated by performing PCR with Q5 polymerase (NEB M0491) according to the recommended protocol, with template oligos for each backbone and amplification primers with the T7 promoter and the spacer sequence. The DNA primer sequences for the T7 promoter, guide and spacer for guides and spacers are presented in Table 11, below. The template oligos, labeled "backbone fwd" and "backbone rev" for each scaffold, were included at a final concentration of 20 nM each, and the amplification primers (T7 promoter and the unique spacer primer) were included at a final concentration of 1 uM each. The sg2, sg32, sg64, and sg174 guides correspond to SEQ ID NOS: 5, 2104, 2106, and 2238, respectively, with the exception that sg2, sg32, and sg64 were modified with an additional 5' G to increase transcription efficiency (compare sequences in Table 11 to Table 2). The 7.37 spacer targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM $MgCl_2$, 0.01% Triton X-100, 2 mM spermidine, 20 mM DTT, 5 mM NTPs, 0.5 μM template, and 100 μg/mL T7 RNA polymerase. Reactions were incubated at 37° C. overnight. 20 units of DNase I (Promega #M6101)) were added per 1 mL of transcription volume and incubated for one hour. RNA products were purified via denaturing PAGE, ethanol precipitated, and resuspended in 1x phosphate buffered saline. To fold the sgRNAs, samples were heated to 70° C. for 5 min and then cooled to room temperature. The reactions were supplemented to 1 mM final $MgCl_2$ concentration, heated to 50° C. for 5 min and then cooled to room temperature. Final RNA guide products were stored at −80° C.

TABLE 11

Sequences for generation of guide RNA

| Primer | Primer sequence | RNA product |
|---|---|---|
| T7 promoter primer | GAAATTAATACGACTCACTATA (SEQ ID NO: 259) | Used for all |
| sg2 backbone fwd | GAAATTAATACGACTCACTATAGGTACTGGCGCTTT TATCTCATTACTTTGAGAGCCATCACCAGCGACTAT GTCGTATGGGTAAAG (SEQ ID NO: 260) | GGUACUGGCGCUUUUAUCUCAUUACUUUGA GAGCCAUCACCAGCGACUAUGUCGUAUGGG UAAAGCGCUUAUUUAUCGGAGAGAAAUCCG |
| sg2 backbone rev | CTTTGATGCTTCTTATTTATCGGATTTCTCTCCGAT AAATAAGCGCTTTACCCATACGACATAGTCGCTGGT GATGGC (SEQ ID NO: 261) | AUAAAUAAGAAGCAUCAAAGGGCCGAGAUG UCUCGCUCCG (SEQ ID NO: 272) |
| sg2.7.37 spacer primer | CGGAGCGAGACATCTCGGCCCTTTGATGCTTCTTAT TTATCGGATTTCTCTCCG (SEQ ID NO: 262) | |

TABLE 11-continued

Sequences for generation of guide RNA

| Primer | Primer sequence | RNA product |
|---|---|---|
| sg32 backbone fwd | GAAATTAATACGACTCACTATAGGTACTGGCGCTTT TATCTCATTACTTTGAGAGCCATCACCAGCGACTAT GTCGTATGGGTAAAGCGC (SEQ ID NO: 263) | GGUACUGGCGCUUUUAUCUCAUUACUUUGA GAGCCAUCACCAGCGACUAUGUCGUAUGGG UAAAGCGCCCUCUUCGGAGGGAAGCAUCAA |
| sg32 backbone rev | CTTTGATGCTTCCCTCCGAAGAGGGCGCTTTACCCA TACGACATAG (SEQ ID NO: 264) | AGGGCCGAGAUGUCUCG (SEQ ID NO: 273) |
| sg32.7.37 spacer primer | CGGAGCGAGACATCTCGGCCCTTTGATGCTTCCCTC CGAAGAG (SEQ ID NO: 265) | |
| sg64 backbone fwd | GAAATTAATACGACTCACTATAGGTACTGGCGCTT TATCTCATTACTTTGAGAGCCATCACCAGCGACTAT GTCGTATGGGTAAAGCGC (SEQ ID NO: 266) | GGUACUGGCGCCUUUAUCUCAUUACUUUGA GAGCCAUCACCAGCGACUAUGUCGUAUGGG UAAAGCGCUUACGGACUUCGGUCCGUAAGA |
| sg64 backbone rev | CTTTGATGCTTCTTACGGACCGAAGTCCGTAAGCGC TTTACCCATACGACATAG (SEQ ID NO: 267) | AGCAUCAAAGGGCCGAGAUGUCUCGCUCCG (SEQ ID NO: 274) |
| sg64.7.37 spacer primer | CGGAGCGAGACATCTCGGCCCTTTGATGCTTCTTAC GGACCGAAG (SEQ ID NO: 268) | |
| sg174 backbone fwd | GAAATTAATACGACTCACTATAACTGGCGCTTTTAT CTGATTACTTTGAGAGCCATCACCAGCGACTATGTC GTAGTGGGTAAAGCT (SEQ ID NO: 269) | ACUGGCGCUUUUAUCUgAUUACUUUGAGAG CCAUCACCAGCGACUAUGUCGUAgUGGGUA AAGCUCCCUCUUCGGAGGGAGCAUCAAAGG |
| sg174 backbone rev | CTTTGATGCTCCCTCCGAAGAGGGAGCTTTACCCAC TACGACATAGTCGC (SEQ ID NO: 270) | GCCGAGAUGUCUCGCUCCG (SEQ ID NO: 275) |
| sg174.7.37 spacer primer | CGGAGCGAGACATCTCGGCCCTTTGATGCTCCCTCC (SEQ ID NO: 271) | |

Example 7: RNP Assembly

Purified wild-type and RNP of CasX and single guide RNA (sgRNA) were either prepared immediately before experiments or prepared and snap-frozen in liquid nitrogen and stored at −80° C. for later use. To prepare the RNP complexes, the CasX protein was incubated with sgRNA at 1:1.2 molar ratio. Briefly, sgRNA was added to Buffer #1 (25 mM NaPi, 150 mM NaCl, 200 mM trehalose, 1 mM MgCl2), then the CasX was added to the sgRNA solution, slowly with swirling, and incubated at 37° C. for 10 min to form RNP complexes. RNP complexes were filtered before use through a 0.22 µm Costar 8160 filters that were pre-wet with 200 µl Buffer #1. If needed, the RNP sample was concentrated with a 0.5 ml Ultra 100-$K_d$ cutoff filter, (Millipore part #UFC510096), until the desired volume was obtained. Formation of competent RNP was assessed as described in Example 14.

Example 8: Assessing Binding Affinity to the Guide RNA

Purified wild-type and improved CasX will be incubated with synthetic single-guide RNA containing a 3' Cy7.5 moiety in low-salt buffer containing magnesium chloride as well as heparin to prevent non-specific binding and aggregation. The sgRNA will be maintained at a concentration of 10 pM, while the protein will be titrated from 1 pM to 100 µM in separate binding reactions. After allowing the reaction to come to equilibrium, the samples will be run through a vacuum manifold filter-binding assay with a nitrocellulose membrane and a positively charged nylon membrane, which bind protein and nucleic acid, respectively. The membranes will be imaged to identify guide RNA, and the fraction of bound vs unbound RNA will be determined by the amount of fluorescence on the nitrocellulose vs nylon membrane for each protein concentration to calculate the dissociation constant of the protein-sgRNA complex. The experiment will also be carried out with improved variants of the sgRNA to determine if these mutations also affect the affinity of the guide for the wild-type and mutant proteins. We will also perform electromobility shift assays to qualitatively compare to the filter-binding assay and confirm that soluble binding, rather than aggregation, is the primary contributor to protein-RNA association.

Example 9: Assessing Binding Affinity to the Target DNA

Purified wild-type and improved CasX will be complexed with single-guide RNA bearing a targeting sequence complementary to the target nucleic acid. The RNP complex will be incubated with double-stranded target DNA containing a PAM and the appropriate target nucleic acid sequence with a 5' Cy7.5 label on the target strand in low-salt buffer containing magnesium chloride as well as heparin to prevent non-specific binding and aggregation. The target DNA will be maintained at a concentration of 1 nM, while the RNP will be titrated from 1 pM to 100 µM in separate binding reactions. After allowing the reaction to come to equilibrium, the samples will be run on a native 5% polyacrylamide gel to separate bound and unbound target DNA. The gel will be imaged to identify mobility shifts of the target DNA, and the fraction of bound vs unbound DNA will be calculated for each protein concentration to determine the dissociation constant of the RNP-target DNA ternary complex.

Example 10: Editing of Gene Targets PCSK9, PMP22, TRAC, SOD1, B2M and HTT

The purpose of this study was to evaluate the ability of the CasX variant 119 and gNA variant 174 to edit nucleic acid sequences in six gene targets.
Materials and Methods
Spacers for all targets except B2M and SOD1 were designed in an unbiased manner based on PAM requirements (TTC or CTC) to target a desired locus of interest. Spacers targeting B2M and SOD1 had been previously identified within targeted exons via lentiviral spacer screens carried out for these genes. Designed spacers for the other targets were ordered from Integrated DNA Technologies (IDT) as single-stranded DNA (ssDNA) oligo pairs. ssDNA spacer pairs were annealed together and cloned via Golden Gate cloning into a base mammalian-expression plasmid construct that contains the following components: codon optimized Cas X 119 protein+NLS under an EF1A promoter, guide scaffold 174 under a U6 promoter, carbenicillin and puromycin resistance genes. Assembled products were transformed into chemically-competent E. coli, plated on Lb-Agar plates (LB: Teknova Cat #L9315, Agar: Quartzy Cat #214510) containing carbenicillin and incubated at 37° C. Individual colonies were picked and miniprepped using Qiagen Qiaprep® spin Miniprep Kit (Qiagen Cat #27104) following the manufacturer's protocol. The resulting plasmids were sequenced through the guide scaffold region via Sanger sequencing (Quintara Biosciences) to ensure correct ligation.

HEK 293T cells were grown in Dulbecco's Modified Eagle Medium (DMEM; Corning Cellgro, #10-013-CV) supplemented with 10% fetal bovine serum (FBS; Seradigm, #1500-500), 100 Units/ml penicillin and 100 mg/ml streptomycin (100x-Pen-Strep; GIBCO #15140-122), sodium pyruvate (100x, Thermofisher #11360070), non-essential amino acids (100× Thermofisher #11140050), HEPES buffer (100× Thermofisher #15630080), and 2-mercaptoethanol (1000× Thermofisher #21985023). Cells were passed every 3-5 days using Tryp1E and maintained in an incubator at 37° C. and 5% CO2.

On day 0, HEK293T cells were seeded in 96-well, flat-bottom plates at 30 k cells/well. On day 1, cells were transfected with 100 ng plasmid DNA using Lipofectamine™ 3000 according to the manufacturer's protocol. On day 2, cells were switched to FB medium containing puromycin. On day 3, this media was replaced with fresh FB medium containing puromycin. The protocol after this point diverged depending on the gene of interest. Day 4 for PCSK9, PMP22, and TRAC: cells were verified to have completed selection and switched to FB medium without puromycin. Day 4 for B2M, SOD1, and HTT: cells were verified to have completed selection and passed 1:3 using Tryp1E into new plates containing FB medium without puromycin. Day 7 for PCSK9, PMP22, and TRAC: cells were lifted from the plate, washed in dPBS, counted, and resuspended in Quick Extract (Lucigen, QE09050) at 10,000 cells/μl. Genomic DNA was extracted according to the manufacturer's protocol and stored at −20° C. Day 7 for B2M, SOD1, and HTT: cells were lifted from the plate, washed in dPBS, and genomic DNA was extracted with the Quick-DNA Miniprep Plus Kit (Zymo, D4068) according to the manufacturer's protocol and stored at −20° C.

NGS Analysis: Editing in cells from each experimental sample was assayed using next generation sequencing (NGS) analysis. All PCRs were carried out using the KAPA HiFi HotStart ReadyMix PCR Kit (KR0370). The template for genomic DNA sample PCR was 5 μl of genomic DNA in QE at 10 k cells/4 for PCSK9, PMP22, and TRAC. The template for genomic DNA sample PCR was 400 ng of genomic DNA in water for B2M, SOD1, and HTT. Primers were designed specific to the target genomic location of interest to form a target amplicon. These primers contain additional sequence at the 5' ends to introduce Illumina read and 2 sequences. Further, they contain a 7 nt randomer sequence that functions as a unique molecular identifier (UMI). Quality and quantification of the amplicon was assessed using a Fragment Analyzer DNA analyzer kit (Agilent, dsDNA 35-1500 bp). Amplicons were sequenced on the Illumina Miseq™ according to the manufacturer's instructions. Resultant sequencing reads were aligned to a reference sequence and analyzed for indels. Samples with editing that did not align to the estimated cut location or with unexpected alleles in the spacer region were discarded.

Results

Figure 9:
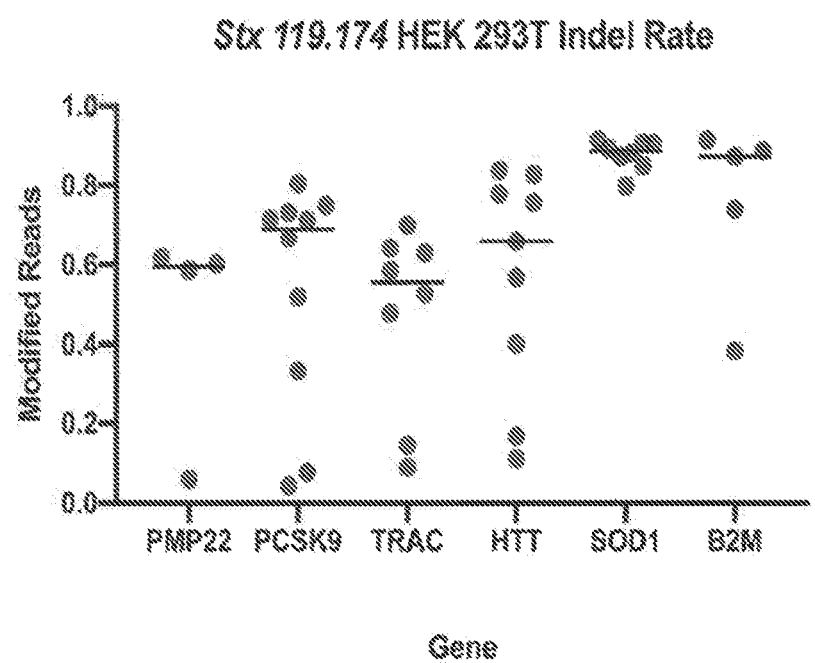
FIG. 9 shows the results of an editing assay of 6 target genes in HEK293T cells, as described in Example 10. Each dot represents results using an individual spacer.
Figure 10:
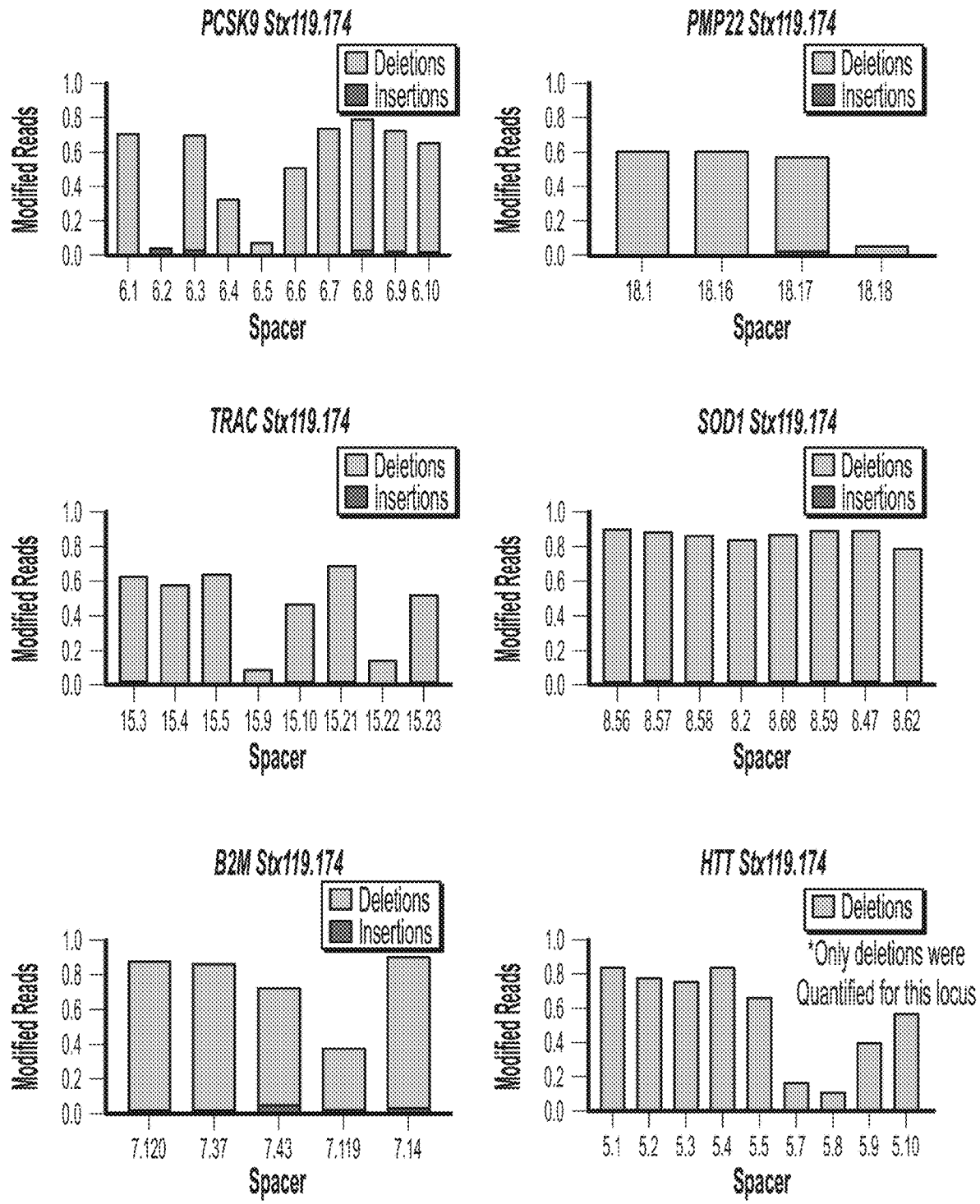
FIG. 10 shows the results of an editing assay of 6 target genes in HEK293T cells, with individual bars representing the results obtained with individual spacers, as described in Example 10.
Figure 11:
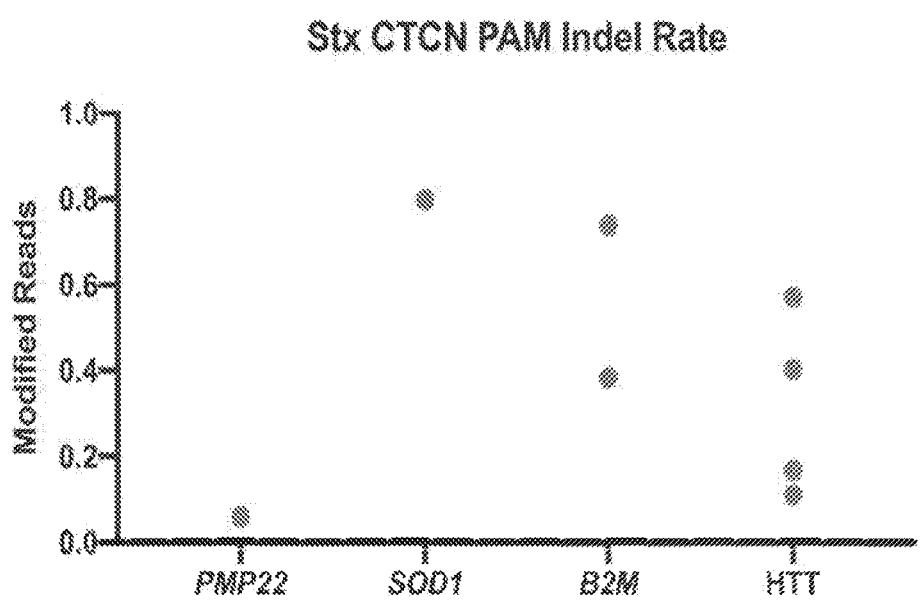
FIG. 11 shows the results of an editing assay of 4 target genes in HEK293T cells, as described in Example 10. Each dot represents results using an individual spacer utilizing a CTC PAM.

In order to validate the editing effected by the CasX:gNA 119.174 at a variety of genetic loci, a clonal plasmid transfection experiment was performed in HEK 293T cells. Multiple spacers (Table 12) were designed and cloned into an expression plasmid encoding the CasX 119 nuclease and guide 174 scaffold. HEK 293T cells were transfected with plasmid DNA, selected with puromycin, and harvested for genomic DNA six days post-transfection. Genomic DNA was analyzed via next generation sequencing (NGS) and aligned to a reference DNA sequence for analysis of insertions or deletions (indels). CasX:gNA 119.174 was able to efficiently generate indels across the 6 target genes, as shown in FIGS. 9 and 10. Indel rates varied between spacers, but median editing rates were consistently at 60% or higher, and in some cases, indel rates as high as 91% were observed. Additionally, spacers with non-canonical CTC PAMs were demonstrated to be able to generate indels with all tested target genes (FIG. 11).

The results demonstrate that the CasX variant 119 and gNA variant 174 can consistently and efficiently generate indels at a wide variety of genetic loci in human cells. The unbiased selection of many of the spacers used in the assays shows the overall effectiveness of the 119.174 RNP molecules to edit genetic loci, while the ability to target to spacers with both a TTC and a CTC PAM demonstrates its increased versatility compared to reference CasX that edit only with the TTC PAM. Table 12 also lists the RNA sequences of the actual spacers; plasmids were created with the corresponding DNA sequences with thymine bases rather than uracil.

TABLE 12

Spacer sequences targeting each genetic locus.

| Gene | Spacer | PAM | Spacer Sequence | Spacer Sequence (RNA) |
|---|---|---|---|---|
| PCSK9 | 6.1 | TTC | GAGGAGGACGGCCTGG CCGA (SEQ ID NO: 276) | GAGGAGGACGGCCUGG CCGA (SEQ ID NO: 320) |
| PCSK9 | 6.2 | TTC | ACCGCTGCGCCAAGGT GCGG (SEQ ID NO: 277) | ACCGCUGCGCCAAGGU GCGG (SEQ ID NO: 321) |
| PCSK9 | 6.4 | TTC | GCCAGGCCGTCCTCCT CGGA (SEQ ID NO: 278) | GCCAGGCCGUCCUCCU CGGA (SEQ ID NO: 322) |
| PCSK9 | 6.5 | TTC | GTGCTCGGGTGCTTCG GCCA (SEQ ID NO: 279) | GUGCUCGGGUGCUUCG GCCA (SEQ ID NO: 323) |
| PCSK9 | 6.3 | TTC | ATGGCCTTCTTCCTGG CTTC (SEQ ID NO: 280) | AUGGCCUUCUUCCUGG CUUC (SEQ ID NO: 324) |
| PCSK9 | 6.6 | TTC | GCACCACCACGTAGGT GCCA (SEQ ID NO: 281) | GCACCACCACGUAGGU GCCA (SEQ ID NO: 325) |
| PCSK9 | 6.7 | TTC | TCCTGGCTTCCTGGTG AAGA (SEQ ID NO: 282) | UCCUGGCUUCCUGGUG AAGA (SEQ ID NO: 326) |
| PCSK9 | 6.8 | TTC | TGGCTTCCTGGTGAAG ATGA (SEQ ID NO: 283) | UGGCUUCCUGGUGAAG AUGA (SEQ ID NO: 327) |

TABLE 12-continued

Spacer sequences targeting each genetic locus.

| Gene | Spacer | PAM | Spacer Sequence | Spacer Sequence (RNA) |
|---|---|---|---|---|
| PCSK9 | 6.9 | TTC | CCAGGAAGCCAGGAAGAAGG (SEQ ID NO: 284) | CCAGGAAGCCAGGAAGAAGG (SEQ ID NO: 328) |
| PCSK9 | 6.10 | TTC | TCCTTGCATGGGGCCAGGAT (SEQ ID NO: 285) | UCCUUGCAUGGGGCCAGGAU (SEQ ID NO: 329) |
| PMP22 | 18.16 | TTC | GGCGGCAAGTTCTGCTCAGC (SEQ ID NO: 286) | GGCGGCAAGUUCUGCUCAGC (SEQ ID NO: 330) |
| PMP22 | 18.17 | TTC | TCTCCACGATCGTCAGCGTG (SEQ ID NO: 287) | UCUCCACGAUCGUCAGCGUG (SEQ ID NO: 331) |
| PMP22 | 18.18 | CTC | ACGATCGTCAGCGTGAGTGC (SEQ ID NO: 288) | ACGAUCGUCAGCGUGAGUGC (SEQ ID NO: 332) |
| PMP22 | 18.1 | TTC | CTCTAGCAATGGATCGTGGG (SEQ ID NO: 289) | CUCUAGCAAUGGAUCGUGGG (SEQ ID NO: 333) |
| TRAC | 15.3 | TTC | CAAACAAATGTGTCACAAAG (SEQ ID NO: 290) | CAAACAAAUGUGUCACAAAG (SEQ ID NO: 334) |
| TRAC | 15.4 | TTC | GATGTGTATATCACAGACAA (SEQ ID NO: 291) | GAUGUGUAUAUCACAGACAA (SEQ ID NO: 335) |
| TRAC | 15.5 | TTC | GGAATAATGCTGTTGTTGAA (SEQ ID NO: 292) | GGAAUAAUGCUGUUGUUGAA (SEQ ID NO: 336) |
| TRAC | 15.9 | TTC | AAATCCAGTGACAAGTCTGT (SEQ ID NO: 293) | AAAUCCAGUGACAAGUCUGU (SEQ ID NO: 337) |
| TRAC | 15.10 | TTC | AGGCCACAGCACTGTTGCTC (SEQ ID NO: 294) | AGGCCACAGCACUGUUGCUC (SEQ ID NO: 338) |
| TRAC | 15.21 | TTC | AGAAGACACCTTCTTCCCCA (SEQ ID NO: 295) | AGAAGACACCUUCUUCCCCA (SEQ ID NO: 339) |
| TRAC | 15.22 | TTC | TCCCCAGCCCAGGTAAGGGC (SEQ ID NO: 296) | UCCCCAGCCCAGGUAAGGGC (SEQ ID NO: 340) |
| TRAC | 15.23 | TTC | CCAGCCCAGGTAAGGGCAGC (SEQ ID NO: 297) | CCAGCCCAGGUAAGGGCAGC (SEQ ID NO: 341) |
| HTT | 5.1 | TTC | AGTCCCTCAAGTCCTTCCAG (SEQ ID NO: 298) | AGUCCCUCAAGUCCUUCCAG (SEQ ID NO: 342) |
| HTT | 5.2 | TTC | AGCAGCAGCAGCAGCAGCAGCA (SEQ ID NO: 299) | AGCAGCAGCAGCAGCAGCA (SEQ ID NO: 343) |
| HTT | 5.3 | TTC | TCAGCCGCCGCCGCAGGCAC (SEQ ID NO: 300) | UCAGCCGCCGCCGCAGGCAC (SEQ ID NO: 344) |
| HTT | 5.4 | TTC | AGGGTCGCCATGGCGGTCTC (SEQ ID NO: 301) | AGGGUCGCCAUGGCGGUCUC (SEQ ID NO: 345) |
| HTT | 5.5 | TTC | TCAGCTTTTCCAGGGTCGCC (SEQ ID NO: 302) | UCAGCUUUUCCAGGGUCGCC (SEQ ID NO: 346) |
| HTT | 5.7 | CTC | GCCGCAGCCGCCCCCGCCGC (SEQ ID NO: 303) | GCCGCAGCCGCCCCCGCCGC (SEQ ID NO: 347) |
| HTT | 5.8 | CTC | GCCACAGCCGGGCCGGTGG (SEQ ID NO: 304) | GCCACAGCCGGGCCGGUGG (SEQ ID NO: 348) |
| HTT | 5.9 | CTC | TCAGCCACAGCCGGGCCGGG (SEQ ID NO: 305) | UCAGCCACAGCCGGGCCGGG (SEQ ID NO: 349) |
| HTT | 5.10 | CTC | CGGTCGGTGCAGCGGCTCCT (SEQ ID NO: 306) | CGGUCGGUGCAGCGGCUCCU (SEQ ID NO: 350) |
| SOD1 | 8.56 | TTC | CCACACCTTCACTGGTCCAT (SEQ ID NO: 307) | CCACACCUUCACUGGUCCAU (SEQ ID NO: 351) |
| SOD1 | 8.57 | TTC | TAAAGGAAAGTAATGGACCA (SEQ ID NO: 308) | UAAAGGAAAGUAAUGGACCA (SEQ ID NO: 352) |
| SOD1 | 8.58 | TTC | CTGGTCCATTACTTTCCTTT (SEQ ID NO: 309) | CUGGUCCAUUACUUUCCUUU (SEQ ID NO: 353) |
| SOD1 | 8.2 | TTC | ATGTTCATGAGTTTGGAGAT (SEQ ID NO: 310) | AUGUUCAUGAGUUUGGAGAU (SEQ ID NO: 354) |
| SOD1 | 8.68 | TTC | TGAGTTTGGAGATAATACAG (SEQ ID NO: 311) | UGAGUUUGGAGAUAAUACAG (SEQ ID NO: 355) |
| SOD1 | 8.59 | TTC | ATAGACACATCGGCCACACC (SEQ ID NO: 312) | AUAGACACAUCGGCCACACC (SEQ ID NO: 356) |
| SOD1 | 8.47 | TTC | TTATTAGGCATGTTGGAGAC (SEQ ID NO: 313) | UUAUUAGGCAUGUUGGAGAC (SEQ ID NO: 357) |
| SOD1 | 8.62 | CTC | CAGGAGACCATTGCATCATT (SEQ ID NO: 314) | CAGGAGACCAUUGCAUCAUU (SEQ ID NO: 358) |
| B2M | 7.120 | TTC | GGCCTGGAGGCTATCCAGCG (SEQ ID NO: 315) | GGCCUGGAGGCUAUCCAGCG (SEQ ID NO: 359) |
| B2M | 7.37 | TTC | GGCCGAGATGTCTCGCTCCG (SEQ ID NO: 316) | GGCCGAGAUGUCUCGCUCCG (SEQ ID NO: 360) |
| B2M | 7.43 | CTC | AGGCCAGAAAGAGAGTAG (SEQ ID NO: 317) | AGGCCAGAAAGAGAGUAG (SEQ ID NO: 361) |
| B2M | 7.119 | CTC | CGCTGGATAGCCTCCAGGCC (SEQ ID NO: 318) | CGCUGGAUAGCCUCCAGGCC (SEQ ID NO: 362) |

Example 11: Assessing Differential PAM Recognition In Vitro

Purified wild-type and engineered CasX variants will be complexed with single-guide RNA bearing a fixed targeting sequence. The RNP complexes will be added to buffer containing MgCl2 at a final concentration of 100 nM and incubated with 5' Cy7.5-labeled double-stranded target DNA at a concentration of 10 nM. Separate reactions will be carried out with different DNA substrates containing different PAMs adjacent to the target nucleic acid sequence. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the rate of cleavage of the non-canonical PAMs by the CasX variants will be determined.

Example 12: Assessing Nuclease Activity for Double-Strand Cleavage

Purified wild-type and engineered CasX variants will be complexed with single-guide RNA bearing a fixed PM22 targeting sequence. The RNP complexes will be added to buffer containing MgCl2 at a final concentration of 100 nM and incubated with double-stranded target DNA with a 5' Cy7.5 label on either the target or non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of the target and non-target strands by the wild-type and engineered variants will be determined. To more clearly differentiate between changes to target binding vs the rate of catalysis of the nucleolytic reaction itself, the protein concentration will be titrated over a range from 10 nM to 1 uM and cleavage rates will be determined at each concentration to generate a pseudo-Michaelis-Menten fit and determine the kcat* and KM*. Changes to KM* are indicative of altered binding, while changes to kcat* are indicative of altered catalysis.

Example 13: Assessing Target Strand Loading for Cleavage

Purified wild-type and engineered CasX 119 will be complexed with single-guide RNA bearing a fixed PM22 targeting sequence. The RNP complexes will be added to buffer containing MgCl2 at a final concentration of 100 nM and incubated with double-stranded target DNA with a 5' Cy7.5 label on the target strand and a 5' Cy5 label on the non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of both strands by the variants will be determined. Changes to the rate of target strand cleavage but not non-target strand cleavage would be indicative of improvements to the loading of the target strand in the active site for cleavage. This activity could be further isolated by repeating the assay with a dsDNA substrate that has a gap on the non-target strand, mimicking a pre-cleaved substrate. Improved cleavage of the non-target strand in this context would give further evidence that the loading and cleavage of the target strand, rather

Example 14: CasX:gNA In Vitro Cleavage Assays

1. Determining cleavage-competent fractions for protein variants compared to wild-type reference CasX The ability of CasX variants to form active RNP compared to reference CasX was determined using an in vitro cleavage assay. The beta-2 microglobulin (B2M) 7.37 target for the cleavage assay was created as follows. DNA oligos with the sequence TGAAGCTGACAGCAT-TCGGGCCGAGATGTCTCGCTCCGTGGCCT-TAGCTGTGCTC GCGCT (SEQ ID NO: 364; non-target strand, NTS) and TGAAGCTGACAGCAT-TCGGGCCGAGATGTCTCGCTCCGTGGCCT-TAGCTGTGCTC GCGCT (SEQ ID NO: 365; target strand, TS) were purchased with 5' fluorescent labels (LI-COR IRDye 700 and 800, respectively). dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM $MgCl_2$), heating to 95° C. for 10 minutes, and allowing the solution to cool to room temperature.

CasX RNPs were reconstituted with the indicated CasX and guides (see FIGS. 12 and 13) at a final concentration of 1 μM with 1.5-fold excess of the indicated guide unless otherwise specified in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. The 7.37 target was used, along with sgRNAs having spacers complementary to the 7.37 target.

Figure 12:
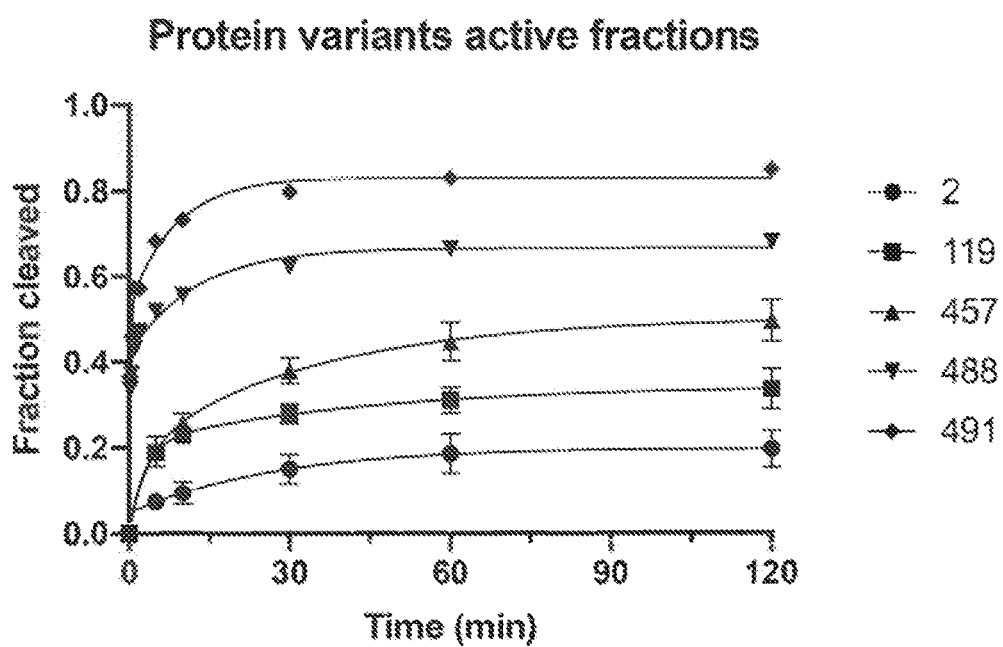
FIG. 12 is a graph of the results of an assay for the quantification of active fractions of RNP formed by sgRNA174 and the CasX variants, as described in Example 14. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to the reference CasX protein of SEQ ID NO: 2.

Cleavage reactions were prepared with final RNP concentrations of 100 nM and a final target concentration of 100 nM. Reactions were carried out at 37° C. and initiated by the addition of the 7.37 target DNA. Aliquots were taken at 5, 10, 30, 60, and 120 minutes and quenched by adding to 95% formamide, 20 mM EDTA. Samples were denatured by heating at 95° C. for 10 minutes and run on a 10% urea-PAGE gel. The gels were either imaged with a LI-COR Odyssey CLx and quantified using the LI-COR Image Studio software or imaged with a Cytiva Typhoon and quantified using the Cytiva IQTL software. The resulting data were plotted and analyzed using Prism. We assumed that CasX acts essentially as a single-turnover enzyme under the assayed conditions, as indicated by the observation that sub-stoichiometric amounts of enzyme fail to cleave a greater-than-stoichiometric amount of target even under extended time-scales and instead approach a plateau that scales with the amount of enzyme present. Thus, the fraction of target cleaved over long time-scales by an equimolar amount of RNP is indicative of what fraction of the RNP is properly formed and active for cleavage. The cleavage traces were fit with a biphasic rate model, as the cleavage reaction clearly deviates from monophasic under this concentration regime, and the plateau was determined for each of three independent replicates. The mean and standard deviation were calculated to determine the active fraction (Table 13). The results are shown in FIG. 12.

Apparent active (competent) fractions were determined for RNPs formed for CasX2+guide 174+7.37 spacer, CasX119+guide 174+7.37 spacer, CasX457+guide 174+7.37 spacer, CasX488+guide 174+7.37 spacer, and CasX491+guide 174+7.37 spacer. The determined active fractions are shown in Table 13. All CasX variants had higher active fractions than the wild-type CasX2, indicating that the engineered CasX variants form significantly more active and stable RNP with the identical guide under tested conditions compared to wild-type CasX. This may be due to an increased affinity for the sgRNA, increased stability or solubility in the presence of sgRNA, or greater stability of a cleavage-competent conformation of the engineered CasX: sgRNA complex. An increase in solubility of the RNP was indicated by a notable decrease in the observed precipitate formed when CasX457, CasX488, or CasX491 was added to the sgRNA compared to CasX2.

Figure 13:
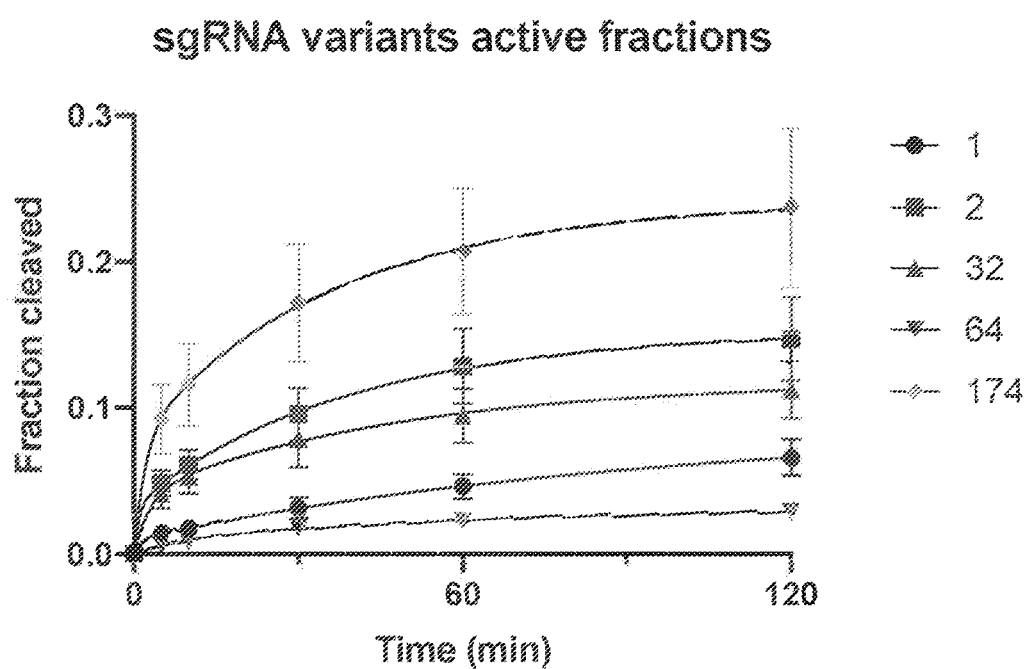
FIG. 13 shows the quantification of active fractions of RNP formed by CasX2 and the modified sgRNAs, as described in Example 14. Equimolar amounts of RNP and target were co-incubated and the amount of cleaved target was determined at the indicated timepoints. Mean and standard deviation of three independent replicates are shown for each timepoint. The biphasic fit of the combined replicates is shown.

2. In vitro Cleavage Assays—Determining $k_{cleave}$ for CasX variants compared to wild-type reference CasX Cleavage-competent fractions were also determined using the same protocol for CasX2.2.7.37, CasX2.32.7.37, CasX2.64.7.37, and CasX2.174.7.37 to be 16±3%, 13±3%, 5±2%, and 22±5%, as shown in FIG. 13 and Table 13.

Figure 14:
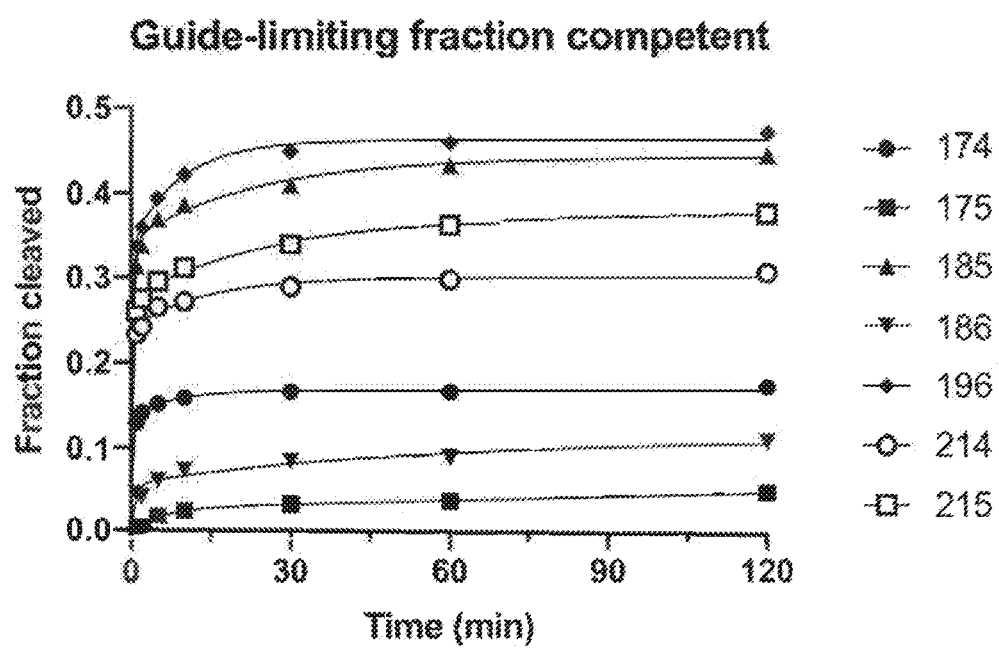
FIG. 14 shows the quantification of active fractions of RNP formed by CasX 491 and the modified sgRNAs under guide-limiting conditions, as described in Example 14. Equimolar amounts of RNP and target were co-incubated and the amount of cleaved target was determined at the indicated timepoints. The biphasic fit of the data is shown.

A second set of guides were tested under different conditions to better isolate the contribution of the guide to RNP formation. 174, 175, 185, 186, 196, 214, and 215 guides with 7.37 spacer were mixed with CasX491 at final concentrations of 1 µM for the guide and 1.5 µM for the protein, rather than with excess guide as before. Results are shown in FIG. 14 and Table 13. Many of these guides exhibited additional improvement over 174, with 185 and 196 achieving 44% and 46% competent fractions, respectively, compared with 17% for 174 under these guide-limiting conditions.

The data indicate that both CasX variants and sgRNA variants are able to form a higher degree of active RNP with guide RNA compare to wild-type CasX and wild-type sgRNA.

The apparent cleavage rates of CasX variants 119, 457, 488, and 491 compared to wild-type reference CasX were determined using an in vitro fluorescent assay for cleavage of the target 7.37.

Figure 18:
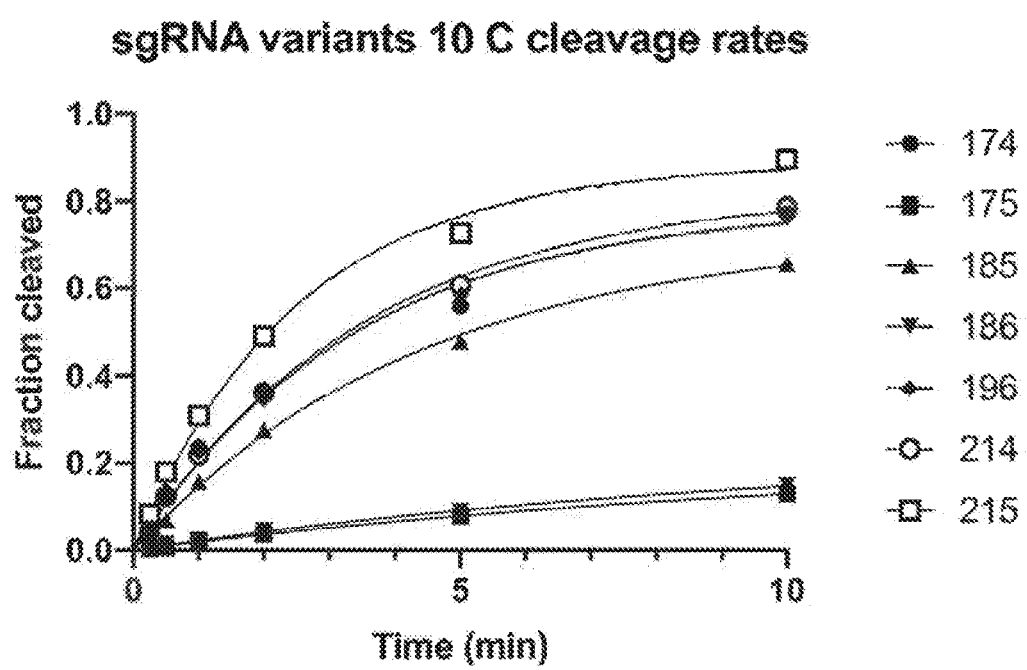
FIG. 18 shows the quantification of cleavage rates of RNP formed by CasX491 and the sgRNA variants, as described in Example 14. Target DNA was incubated with a 20-fold excess of the indicated RNP at 10° C. and the amount of cleaved target was determined at the indicated time points. The monophasic fit of the timepoints is shown.

CasX RNPs were reconstituted with the indicated CasX (see FIG. 14) at a final concentration of 1 µM with 1.5-fold excess of the indicated guide in 1×cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. Cleavage reactions were set up with a final RNP concentration of 200 nM and a final target concentration of 10 nM. Reactions were carried out at 37° C. except where otherwise noted and initiated by the addition of the target DNA. Aliquots were taken at 0.25, 0.5, 1, 2, 5, and 10 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software or imaged with a Cytiva Typhoon and quantified using the Cytiva IQTL software. The resulting data were plotted and analyzed using Prism, and the apparent first-order rate constant of non-target strand cleavage ($k_{cleave}$) was determined for each CasX:sgRNA combination replicate individually. The mean and standard deviation of three replicates with independent fits are presented in Table 13, and the cleavage traces are shown in FIG. 18.

Figure 15:
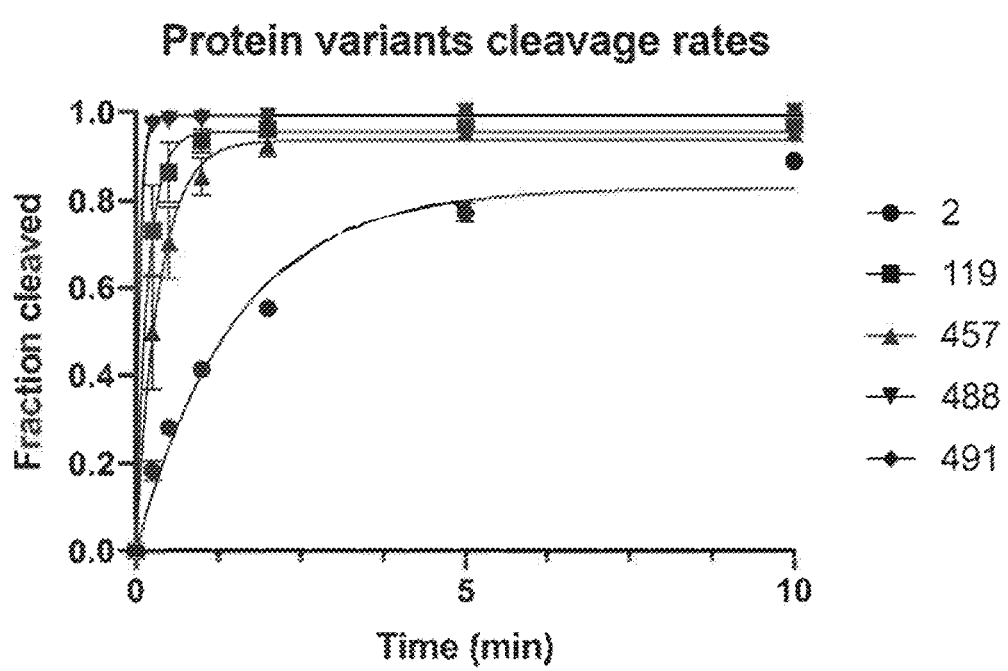
FIG. 15 shows the quantification of cleavage rates of RNP formed by sgRNA174 and the CasX variants, as described in Example 14. Target DNA was incubated with a 20-fold excess of the indicated RNP and the amount of cleaved target was determined at the indicated time points. Mean and standard deviation of three independent replicates are shown for each timepoint, except for 488 and 491 where a single replicate is shown. The monophasic fit of the combined replicates is shown.

Apparent cleavage rate constants were determined for wild-type CasX2, and CasX variants 119, 457, 488, and 491 with guide 174 and spacer 7.37 utilized in each assay (see Table 13 and FIG. 15). All CasX variants had improved cleavage rates relative to the wild-type CasX2. CasX457 cleaved more slowly than 119, despite having a higher competent fraction as determined above. CasX488 and CasX491 had the highest cleavage rates by a large margin; as the target was almost entirely cleaved in the first timepoint, the true cleavage rate exceeds the resolution of this assay, and the reported $k_{cleave}$ should be taken as a lower bound.

The data indicate that the CasX variants have a higher level of activity, with $k_{cleave}$ rates reaching at least 30-fold higher compared to wild-type CasX2.

4. In Vitro Cleavage Assays: Comparison of Guide Variants to Wild-Type Guides

Cleavage assays were also performed with wild-type reference CasX2 and reference guide 2 compared to guide variants 32, 64, and 174 to determine whether the variants improved cleavage. The experiments were performed as described above. As many of the resulting RNPs did not approach full cleavage of the target in the time tested, we determined initial reaction velocities (Vo) rather than first-order rate constants. The first two timepoints (15 and 30 seconds) were fit with a line for each CasX:sgRNA combination and replicate. The mean and standard deviation of the slope for three replicates were determined.

Figure 16:
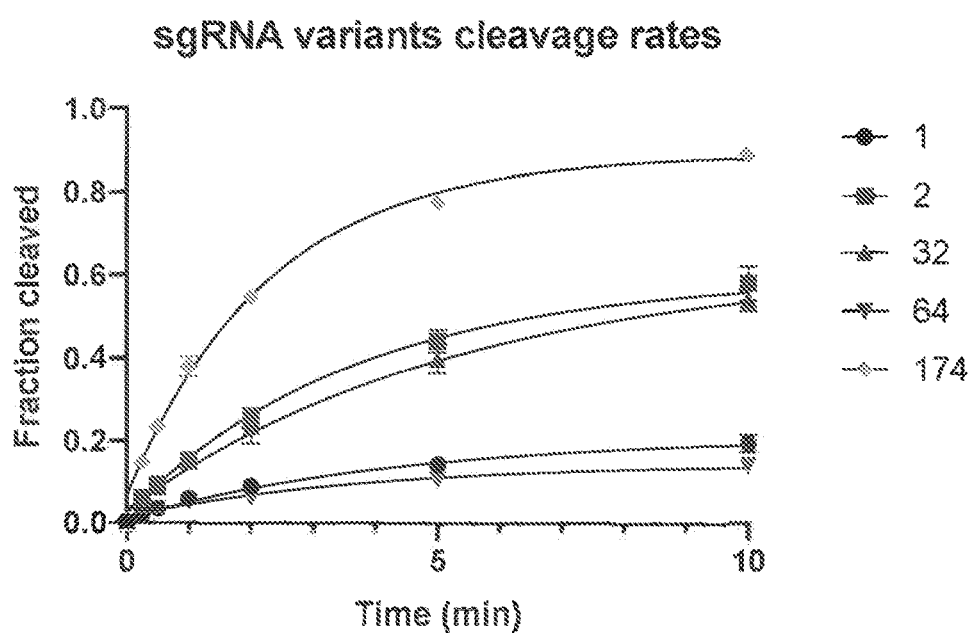
FIG. 16 shows the quantification of cleavage rates of RNP formed by CasX2 and the sgRNA variants, as described in Example 14. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.
Figure 17:
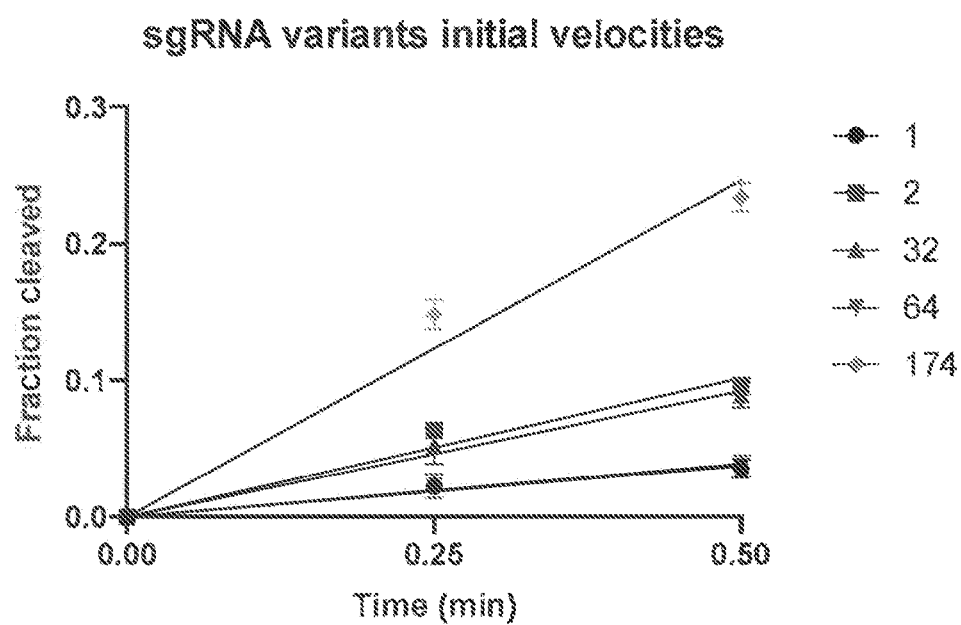
FIG. 17 shows the quantification of initial velocities of RNP formed by CasX2 and the sgRNA variants, as described in Example 14. The first two time-points of the previous cleavage experiment were fit with a linear model to determine the initial cleavage velocity.

Under the assayed conditions, the Vo for CasX2 with guides 2, 32, 64, and 174 were 20.4±1.4 nM/min, 18.4±2.4 nM/min, 7.8±1.8 nM/min, and 49.3±1.4 nM/min (see Table 13, FIG. 16 and FIG. 17). Guide 174 showed substantial improvement in the cleavage rate of the resulting RNP (~2.5-fold relative to 2, see FIG. 17), while guides 32 and 64 performed similar to or worse than guide 2. Notably, guide 64 supports a cleavage rate lower than that of guide 2 but performs much better in vivo (data not shown). Some of the sequence alterations to generate guide 64 likely improve in vivo transcription at the cost of a nucleotide involved in triplex formation. Improved expression of guide 64 likely explains its improved activity in vivo, while its reduced stability may lead to improper folding in vitro.

Additional experiments were carried out with guides 174, 175, 185, 186, 196, 214, and 215 with spacer 7.37 and CasX491 to determine relative cleavage rates. To reduce cleavage kinetics to a range measurable with our assay, the cleavage reactions were incubated at 10° C. Results are in FIG. 18 and Table 13. Under these conditions, 215 was the only guide that supported a faster cleavage rate than 174. 196, which exhibited the highest active fraction of RNP under guide-limiting conditions, had kinetics essentially the same as 174, again highlighting that different variants result in improvements of distinct characteristics. The data support that, under the conditions of the assay, use of the majority of the guide variants with CasX results in RNP with a higher level of activity than one with the wild-type guide, with improvements in initial cleavage velocity ranging from ~2-fold to >6-fold.

TABLE 13

Results of cleavage and RNP formation assays

| RNP Construct | $k_{cleave}$* | Initial velocity* | Competent fraction |
| --- | --- | --- | --- |
| 2.2.7.37 | | 20.4 ± 1.4 nM/min | 16 ± 3% |
| 2.32.7.37 | | 18.4 ± 2.4 nM/min | 13 ± 3% |
| 2.64.7.37 | | 7.8 ± 1.8 nM/min | 5 ± 2% |
| 2.174.7.37 | 0.51 ± 0.01 $min^{-1}$ | 49.3 ± 1.4 nM/min | 22 ± 5% |

TABLE 13-continued

Results of cleavage and RNP formation assays

| RNP Construct | $k_{cleave}$* | Initial velocity* | Competent fraction |
|---|---|---|---|
| 119.174.7.37 | 6.29 ± 2.11 min$^{-1}$ | | 35 ± 6% |
| 457.174.7.37 | 3.01 ± 0.90 min$^{-1}$ | | 53 ± 7% |
| 488.174.7.37 | 15.19 min$^{-1}$ | | 67% |
| 491.174.7.37 | 16.59 min$^{-1}$/0.293 min$^{-1}$ (10° C.) | | 83%/17% (guide-limited) |
| 491.175.7.37 | 0.089 min$^{-1}$ (10° C.) | | 5% (guide-limited) |
| 491.185.7.37 | 0.227 min$^{-1}$ (10° C.) | | 44% (guide-limited) |
| 491.186.7.37 | 0.099 min$^{-1}$ (10° C.) | | 11% (guide-limited) |
| 491.196.7.37 | 0.292 min$^{-1}$ (10° C.) | | 46% (guide-limited) |
| 491.214.7.37 | 0.284 min$^{-1}$ (10° C.) | | 30% (guide-limited) |
| 491.215.7.37 | 0.398 min$^{-1}$ (10° C.) | | 38% (guide-limited) |

*Mean and standard deviation

Example 15: CasX:gNA Editing of SOD1

This example sets forth the parameters to make and test compositions capable of modifying a SOD1 locus.

Experimental Design:

A) SOD1-Modifying Spacer Selection Process:

20 bp XTC PAM spacers were designed to target the following regions in the human genome:

(a) SOD1 cis enhancer elements as described in Fishilevich et al, 2017

(b) SOD1 proximal non-coding genetic elements highly conserved across vertebrates (UCSC genome browser)

(c) SOD1 genomic locus. The SOD1 gene is defined as the sequence that spans chr21:31659622-31668931 of the human genome (GRCh38/hg38) (the notation refers to the chromosome 21 (chr21), starting at the 31,659,622 bp of that chromosome, and extending to the 31,668,931 bp of that chromosome).

SOD1 targeting spacers may be similarly assembled from other genomes.

B) Methods for Generating SOD1 Targeting Constructs:

In order to generate SOD1 targeting constructs, SOD1 targeting spacers were cloned into a base mammalian-expression plasmid construct (pStX) that is comprised of the following components: codon optimized CasX (construct CasX 2 (SEQ ID NO:2) and guide 2 (SEQ ID NO:5) and CasX 119 molecule and rRNA guide 64 (119.64); see Tables 2B and 6 for sequences)+NLS; guide scaffold 64, and a mammalian selection marker, puromycin. Spacer sequence DNA was ordered as single-stranded DNA (ssDNA) oligos from Integrated DNA Technologies (IDT) consisting of the spacer sequence and the reverse complement of this sequence. These two oligos were annealed together and cloned into pStX individually or in bulk by Golden Gate Assembly using T4 DNA Ligase (New England BioLabs Cat #M0202L) and an appropriate restriction enzyme for the plasmid. Assembled products were transformed into chemically- or electro-competent bacterial cells, plated on Lb-Agar plates (LB: Teknova Cat #L9315, Agar: Quartzy Cat #214510) containing carbenicillin and incubated until colonies appeared. Individual colonies were picked and mini-prepped using a Qiagen Qiaprep® spin Miniprep Kit (Qiagen Cat #27104), following the manufacturer's protocol. The resultant plasmids were sequenced using Sanger sequencing to ensure correct ligation. SaCas9 and SpyCas9 control plasmids, with spacers chosen based on Cas protein-specific PAMs, were prepared similarly to pStX plasmids described above.

C) Methods to Generate SOD1 Reporter Line:

A GFP-encoding DNA was knocked in at the 3' end of the last SOD1 exon in a HEK293T cell line. The modified cells were expanded by serial passage every 3-5 days and maintained in Fibroblast (FB) medium, consisting of Dulbecco's Modified Eagle Medium (DMEM; Corning Cellgro, #10-013-CV) supplemented with 10% fetal bovine serum (FBS; Seradigm, #1500-500), and 100 Units/ml penicillin and 100 mg/ml streptomycin (100x-Pen-Strep; GIBCO #15140-122), and can additionally include sodium pyruvate (100x, Thermofisher #11360070), non-essential amino acids (100× Thermofisher #11140050), HEPES buffer (100× Thermofisher #15630080), and 2-mercaptoethanol (1000× Thermofisher #21985023). The cells were incubated at 37° C. and 5% CO2. After 1-2 weeks, single GFP+ cells were sorted into FB medium. The reporter line clones were expanded by serial passage every 3-5 days and maintained in FB medium in an incubator at 37° C. and 5% CO2. The lines were characterized via genomic sequencing, and functional modification of the SOD1 locus using a SOD1 targeting molecule. The optimal reporter lines were identified as ones that i) had a single copy of GFP correctly integrated at the target SOD1 locus, ii) maintained doubling times equivalent to unmodified cells, iii) resulted in reduction in GFP fluorescence upon disruption of the SOD1 gene when assayed using the methods described, below.

D) Methods to Assess SOD1 Modifying Activity in SOD1-GFP Reporter Cell Line:

SOD1-GFP reporter cells were seeded at 20-40 k cells/well in a 96 well plate in 100 µl of FB medium and cultured in a 37C incubator with 5% CO2. The following day, confluence of seeded cells was checked. Ideally, cells should be at ~75% confluence at time of transfection. If cells were at the right confluence, transfection was carried out.

Each CasX construct (CasX 2 (SEQ ID NO:2) and guide 2 (SEQ ID NO:5) and CasX 119 and guide 64, see Tables for sequence) with appropriate spacer targeting SOD1 was transfected at 100-500 ng per well using Lipofectamine™ 3000 following the manufacturer's protocol, using 3 wells per construct as replicates. SaCas9 and SpyCas9 targeting SOD1 were used as benchmarking controls. For each Cas protein type, a non-targeting plasmid was used as a negative control.

After 24-48 hours of puromycin selection at 0.3-3 ug/ml, to select for successfully transfected cells, followed by 24-48 hours of recovery in FB medium, GFP fluorescence in transfected cells was analyzed via flow cytometry. In this process, cells were gated for the appropriate forward and side scatter, selected for single cells and then gated for reporter expression (Attune Nxt Flow Cytometer, Thermo Fisher Scientific) to quantify the expression levels of fluorophores. At least 10,000 events were collected for each sample. The data were then used to calculate the percentage of antibody-label negative (edited) cells.

A subset of cells for each sample from the example was lysed, and genome extracted using a Quick extract solution following the manufacturer's protocol. Editing was analyzed using a T7E1 assay. Briefly, the genomic locus at the targeted edit site was amplified using primers (e.g., a 500 bp region around the intended target) using a PCR program on a thermocycler. The PCR amplicon was then hybridized following a hybridization program on a thermocycler, and then treated with T7 Endonuclease for 30 mins at 37C. The sample was then analyzed on a 2% agarose gel, or on a Fragment Analyzer to visualize DNA bands.

E) Methods to Assess SOD1 Modifying Activity in SY5Y Cells:

SY5Y cells (Cell Culture Facility, UC Berkeley) were seeded at 20-40 k cells/well in a 96 well plate in 100 µl of FB medium and cultured in a 37° C. incubator with 5% CO2. The following day, confluence of seeded cells was checked. Ideally, cells should be at ~75% confluence at time of transfection. If cells were at the right confluence, transfection was carried out.

CasX construct 119 with guide 64 and appropriate spacer targeting SOD1 was transfected at 100-500 ng per well using Lipofectamine™ 3000 following the manufacturer's protocol, and placed into 3 wells per construct as replicates. A non-targeting plasmid was used as a negative control. After 24-48 hours of puromycin selection at 1-3 ug/ml to select for successfully transfected cells, followed by 24-48 hours of recovery in FB medium, cells were analyzed for editing by the T7E1 assay as described above.

F) Methods to Assess SOD1 Modifying Via a Lentiviral Screen

Lentiviral plasmids are cloned as described above and following standard cloning procedures such that each lentiviral plasmid has one spacer-guide scaffold targeting SOD1 and one codon optimized NLS bearing CasX molecule (e.g., construct CasX 119 molecule and rRNA guide 64 (119.64)) with a puromycin selection marker. The cloning is carried out such that the final titer encompasses the full library size by >100× of all possible SOD1 spacers targeting all known PAMs and their corresponding spacer regions in the SOD1 gene. If ~5,000 was the library size; the libraries evaluated would be >5×10$^5$.

Lentiviral particles are produced by transfecting HEK293T at a confluency of 70%-90% using polyethylenimine based transfection of plasmids containing the spacer library, the lentiviral packaging plasmid and the VSV-G envelope plasmids. For particle production, media is changed 12 hr. post-transfection, and virus harvested at 36-48 hr. post-transfection.

Viral supernatants are filtered using 0.45 um membrane filters, diluted in FB media if appropriate, and added to target cells, in this case the SOD1-GFP reporter cell line. Supplement polyberene is added at 5-20 ug/ml to enhance transduction efficiency, if necessary. Transduced cells are selected for 24-48 hr. post-transduction using puromycin at 0.3-3 ug/ml in FB medium, and grown for 7-10 days in FB medium in a 37C incubator with 5% CO2.

Cells are sorted on a SH-100 or MA900 SONY sorter. In this process, cells are gated for the appropriate forward and side scatter, selected for single cells and then gated for reporter expression. Different cell sorting gates are established based on fluorescence level (OFF=full KO, Med=partial disruption or knockdown (KD), High=no edit, Very High=Enhancer) to distinguish between and collect cells editing by i) highly functional SOD1 disrupting molecules, ii) molecules that only lower expression, and iii) molecules that increase expression. This assay can also be run to identify allele specific guides if two colors are used in human patient cells. Genomic DNA are collected from each group of sorted cells using Quick Extract (Lucigen Cat #QE09050) solution following manufacturer's recommended protocol.

Spacer libraries from each collected pool are then amplified via PCR directly from the genome and collected for deep sequencing on a Miseq™. Analysis of the spacers is done according to gate and abundance for a specific activity; see below for detailed methods for NGS analysis of spacer hits.

Selected guides from each sorted group are then re-cloned and individually validated in reporter cell line and in primary human cell lines for activity by flow cytometry and T7E1 assay, and indel spectrum assessed by NGS analysis. Steps followed may be similar to the description provided under Methods to assess SOD1 modifying activity in reporter cell line.

G) Methods for NGS Analysis of Spacer Hits

Provided here are methods on how to analyze the next generation sequencing (NGS) data coming from above described lentiviral screen. Spacers are each assessed for ability to disrupt a SOD1 gene using NGS.

NGS libraries are generated through specific amplification of the lentiviral backbone containing the spacer. A different library is generated for each of the sorted populations (GFP high, med, low, etc., corresponding to low, med, high SOD1 expression), and then assessed with the Illumina Hiseq.

Sequencing reads from the Illumina Hiseq are trimmed for adapter sequences and for regions of low sequencing quality. Paired end reads are merged based on their overlap sequence to form a single consensus sequence per sequenced fragment. Consensus sequences are aligned to the designed spacer sequences using bowtie2. Reads aligning to more than one designed spacer sequence are discarded.

The 'abundance' of each spacer sequence is defined as the number of reads aligning to that sequence. The abundance is tabulated for each sequencing library, forming a count table giving the abundance for each spacer sequence across each of the sequencing libraries (i.e., sorted populations). Finally, the numbers of abundances are then normalized to account for the differing sequencing depth of each library by dividing by the overall read count in that library, multiplied by the mean read count across libraries. The normalized count table is used to determine the activity of each spacer in each gate (high, medium, low, etc.).

Figure 19:
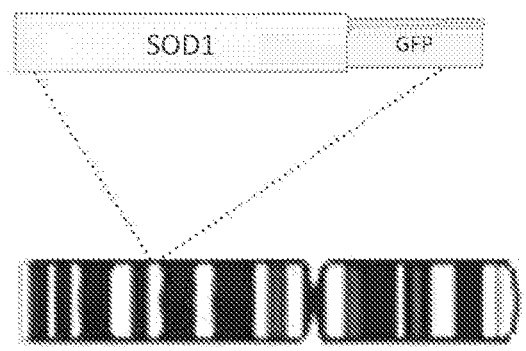
FIG. 19 is a schematic showing construction of the SOD1-GFP reporter line made by knocking in GFP at the endogenous human SOD1 locus, as described in Example 15.
Figure 20:
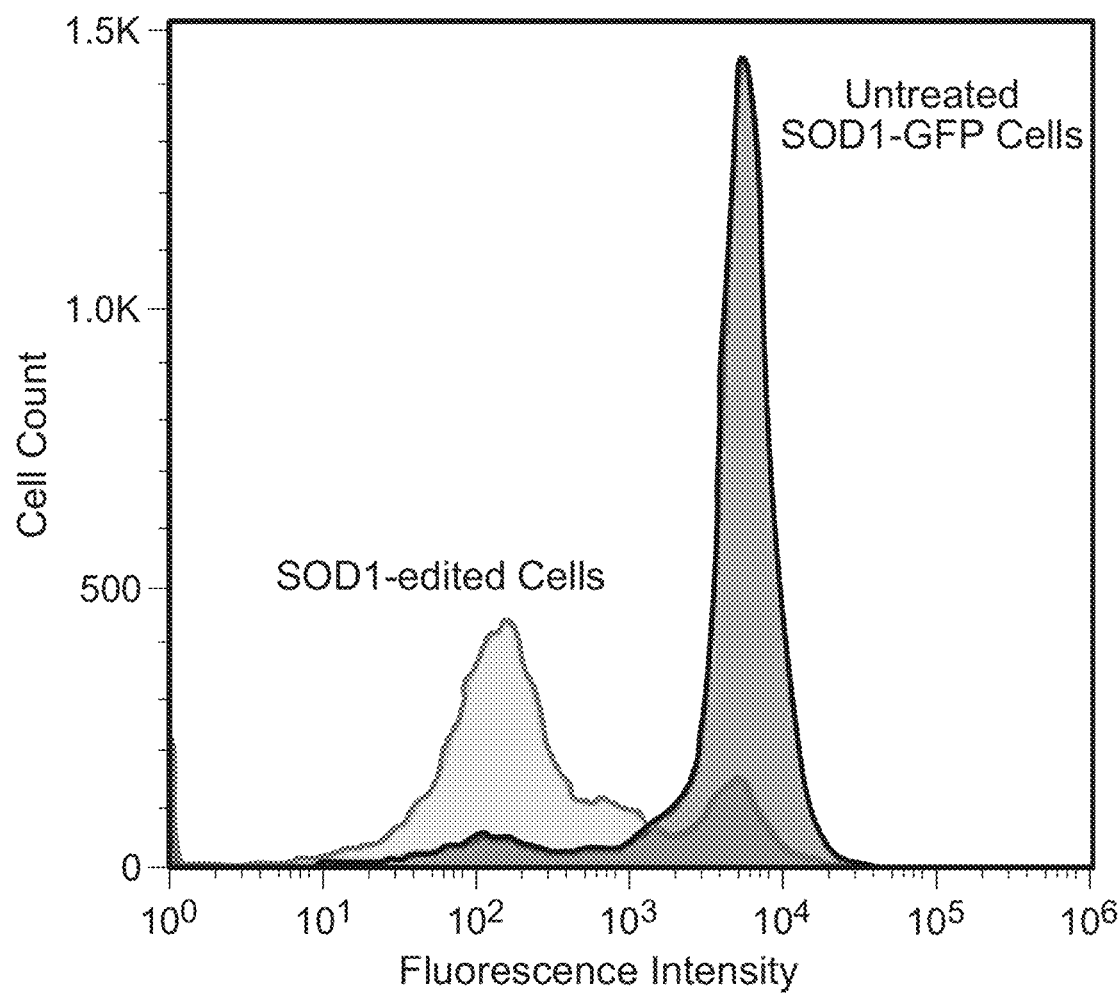
FIG. 20 is an example fluorescence activated cell sorting (FACS) plot illustrating an exemplary method for assaying the effectiveness of a reference CasX protein or single guide RNA (sgRNA), or variants thereof, as described in Example 15.

Results:

A SOD1-GFP reporter line was constructed by knocking in GFP at the endogenous human SOD1 locus, shown schematically in FIG. 19. A reporter (e.g., GFP reporter) coupled to a gRNA targeting sequence, complementary to the gRNA spacer, is integrated into a reporter cell line. Cells are transformed or transfected with a CasX protein and/or sgRNA variant, with the spacer motif of the sgRNA complementary to and targeting the gRNA target sequence of the reporter. The ability of the CasX:sgRNA ribonucleoprotein complex to cleave the target nucleic acid sequence is assayed by FACS. Cells that lose reporter expression indicate occurrence of CasX:sgRNA ribonucleoprotein complex-mediated cleavage and indel formation. The reporting system is based on reduced GFP fluorescence upon successful modifying (editing) of the SOD1 locus, detected by flow cytometry as shown in FIG. 20.

Figure 21:
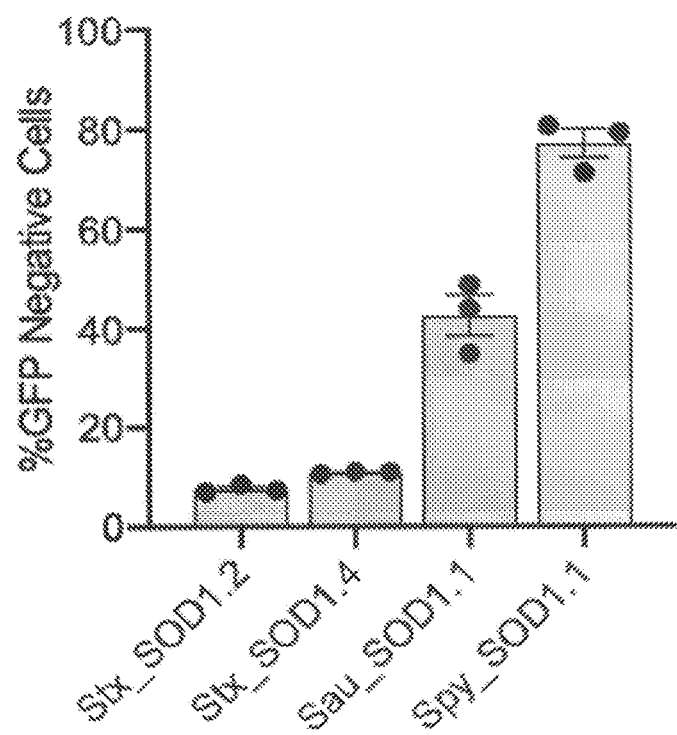
FIG. 21 shows the results of gene editing in the SOD1-GFP reporter cell line, as described in Example 15.
Figure 22:
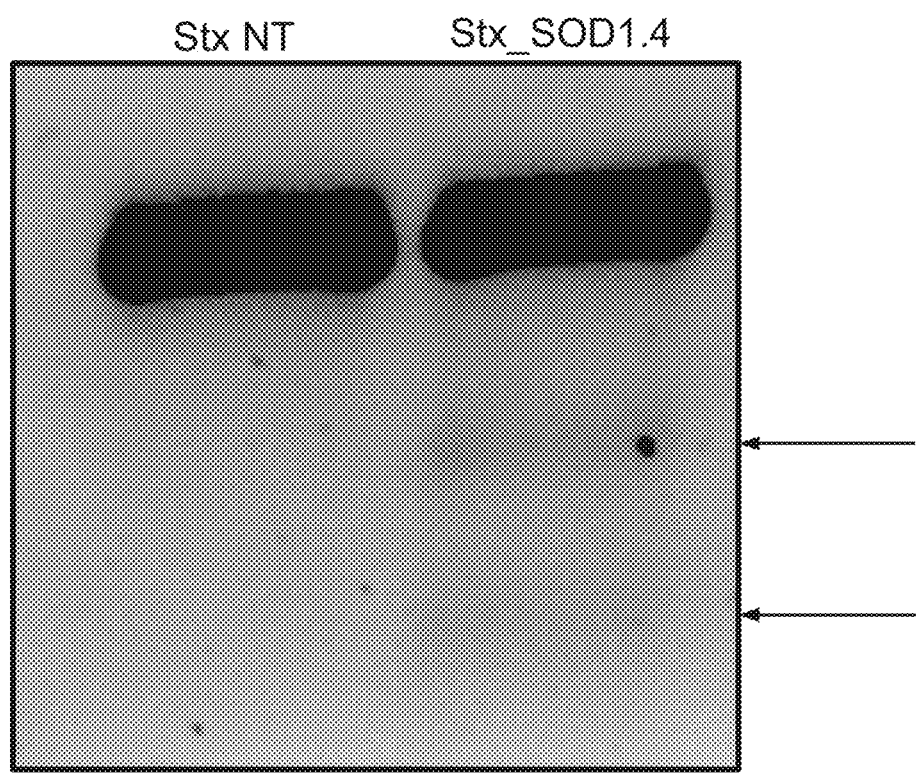
FIG. 22 shows the results of gene editing in the SOD1-GFP reporter cell line, as described in Example 15.

In an initial screen, two SOD1 spacers of the gNA were tested. The spacers 2 (with an encoding sequence ATGTTCATGAGTTTGGAGAT (SEQ ID NO: 310)) and 4 (with an encoding sequence TCGCCATAACTCGCTAGGCC (SEQ ID NO: 366)) were tested with the CasX protein (construct CasX 2 (SEQ ID NO:2) and guide 2 (SEQ ID NO:5)), using SaCas9 and SpyCas9 as controls, in the reporter cell line. The reduction in GFP fluorescence and editing, shown in FIGS. 20 and 21. FIG. 21 shows the edits results of the CasX SOD1 targeting spacers 2 and 4 (first two bars) and benchmarking controls Sa.Cas9 and Spy.Cas9 (second two bars) which were lipofected into SOD1-GFP reporter cells, selected for successful lipofection using puromycin, and later assayed for GFP disruption via FACS. The CasX 2 (SEQ ID NO:2) and guide 2 (SEQ ID NO:5) is shown to edit 5-10% of cells, demonstrating that CasX can modify the endogenous SOD1 locus, and did so more effectively than the SaCas9 and SpyCas9. A T7E1 assay was performed to assay gene editing in the SOD1-GFP reporter cell line. CasX 2 (SEQ ID NO:2) and guide 2 (SEQ ID NO:5) with SOD1 targeting spacer (with an encoding sequence of TCGCCATAACTCGCTAGGCC (SEQ ID NO: 366)) and non-targeting control (NT) were lipofected into SOD1-GFP reporter cells, selected for successful lipofection using puromycin, and later assayed for gene editing in the T7E1 assay. An agarose gel image from the T7E1 assay shown in FIG. 22 demonstrates successful editing of the SOD1 locus, indicated by the double arrows.

Figure 23:
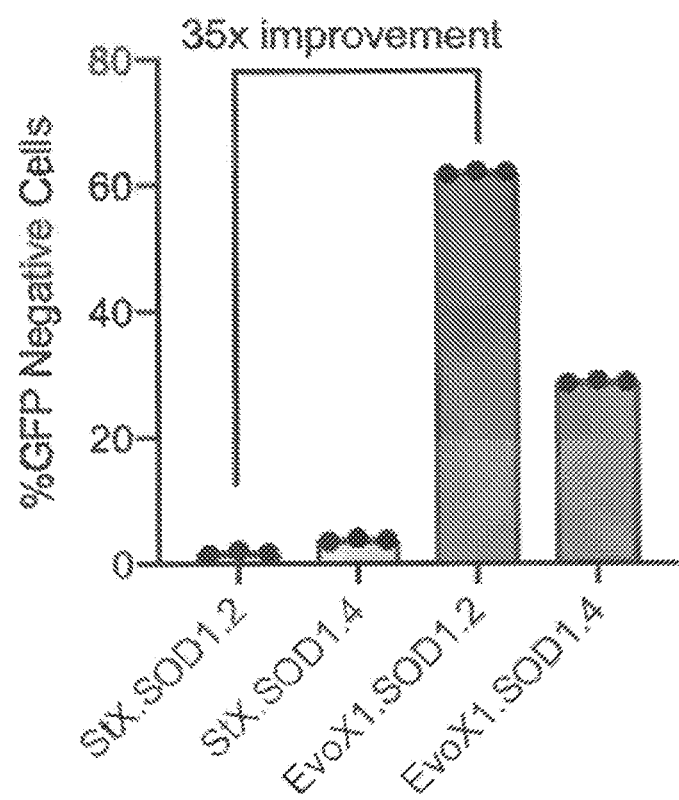
FIG. 23 shows the results of gene editing in the SOD1-GFP reporter cell line, as described in Example 15.

FIG. 23 shows the results of gene editing in the SOD1-GFP reporter cell line. CasX 2 (SEQ ID NO:2) and guide 2 (SEQ ID NO:5) (labeled here as StX) and CasX 119 molecule and rRNA guide 64 (119.64) (labeled here as EvoX1) with SOD1 targeting spacers (2, with an encoding sequence of ATGTTCATGAGTTTGGAGAT (SEQ ID NO: 310), and spacer 4, with an encoding sequence of TCGCCATAACTCGCTAGGCC (SEQ ID NO: 366)), were lipofected into SOD1-GFP reporter cells, selected for successful lipofection using puromycin, and later assayed for GFP disruption via FACS. FIG. 5 shows that CasX 119 with guide 64 edits substantially better than CasX 2 (SEQ ID NO:2) and guide 2 (SEQ ID NO:5); in particular, in the case of spacer 2, CasX 119 with guide 64 shows 35-fold higher editing compared to CasX 2 (SEQ ID NO:2) and guide 2 (SEQ ID NO:5).

Figure 24:
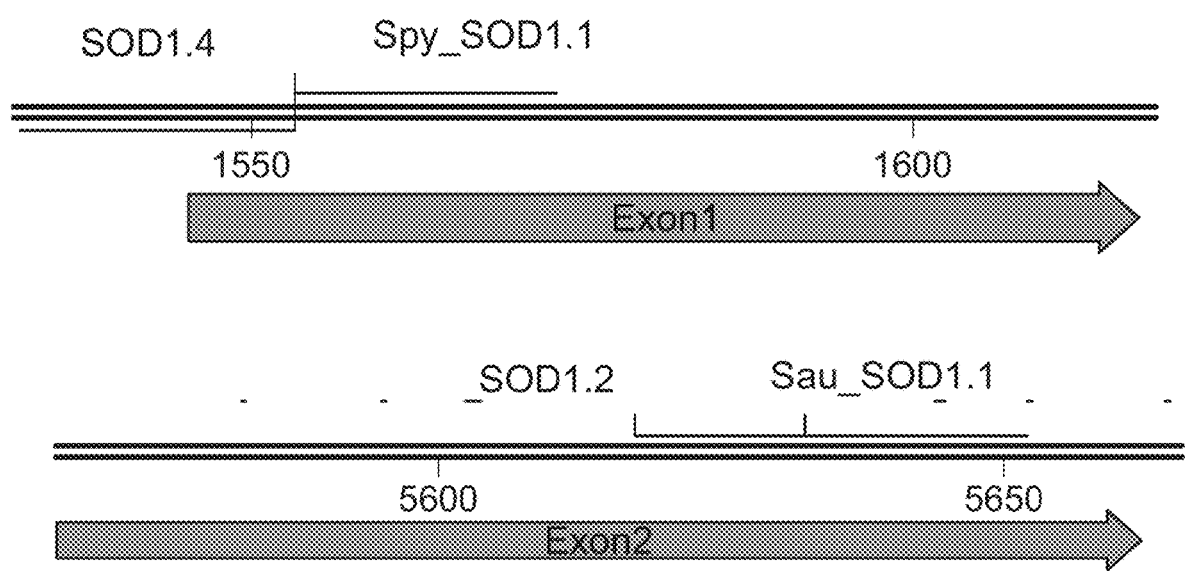
FIG. 24 is a schematic depicting the location of the SOD1 targeting spacers, referred to in Example 15, in the SOD1 gene.

FIG. 23 demonstrates that another CasX variant, construct 119 with guide 64, modifies the SOD1 locus with a 35-fold higher efficiency compared to CasX 2 (SEQ ID NO:2) and guide 2 (SEQ ID NO:5), as measured via flow cytometry of modified SOD1-GFP reporter cells. Rates of about 60% for modifying at the endogenous SOD1 locus were achieved; equal or greater than efficiency demonstrated with SaCas9 (data not shown). The spacers used in these examples are pictorially depicted in FIG. 24, with the CasX SOD1 targeting spacer 4 (SOD1.4) and a SpyCas9 targeting spacer (Spy_SOD1.1) located in Exon 1. The CasX SOD1 targeting spacer 2 (SOD1.2) and a SauCas9 targeting spacer (Sau_SOD1.1) are located in Exon 2.

Figure 25:
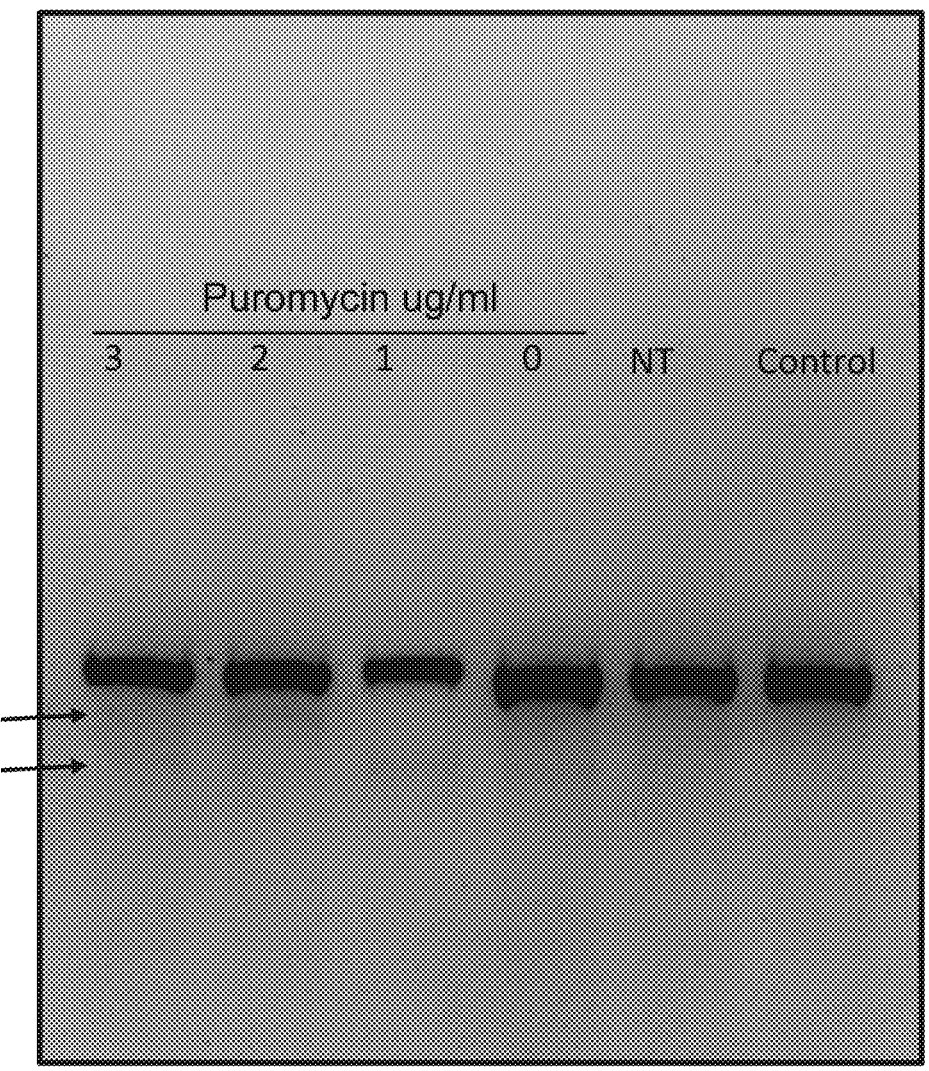
FIG. 25 shows the results of gene editing in the SY5Y cell line, as described in Example 15.

FIG. 25 shows the results of gene editing in the SY5Y cell line. CasX 119 and rRNA guide 64 with a SOD1 targeting spacer (with an encoding sequence of TCGCCATAACTCGCTAGGCC (SEQ ID NO: 366)) and non-targeting control (NT) were lipofected into SY5Y cells, selected for successful lipofection using different concentrations of puromycin (1, 2 or 3 ug/ml), and later assayed for gene editing in the T7E1 assay. The agarose gel image from the T7E1 assay shown in FIG. 25 demonstrates successful editing of the SOD1 locus. The double arrows show the two DNA bands as a result of successful editing in cells selected with 3 µg/ml puromycin.

Figure 26:
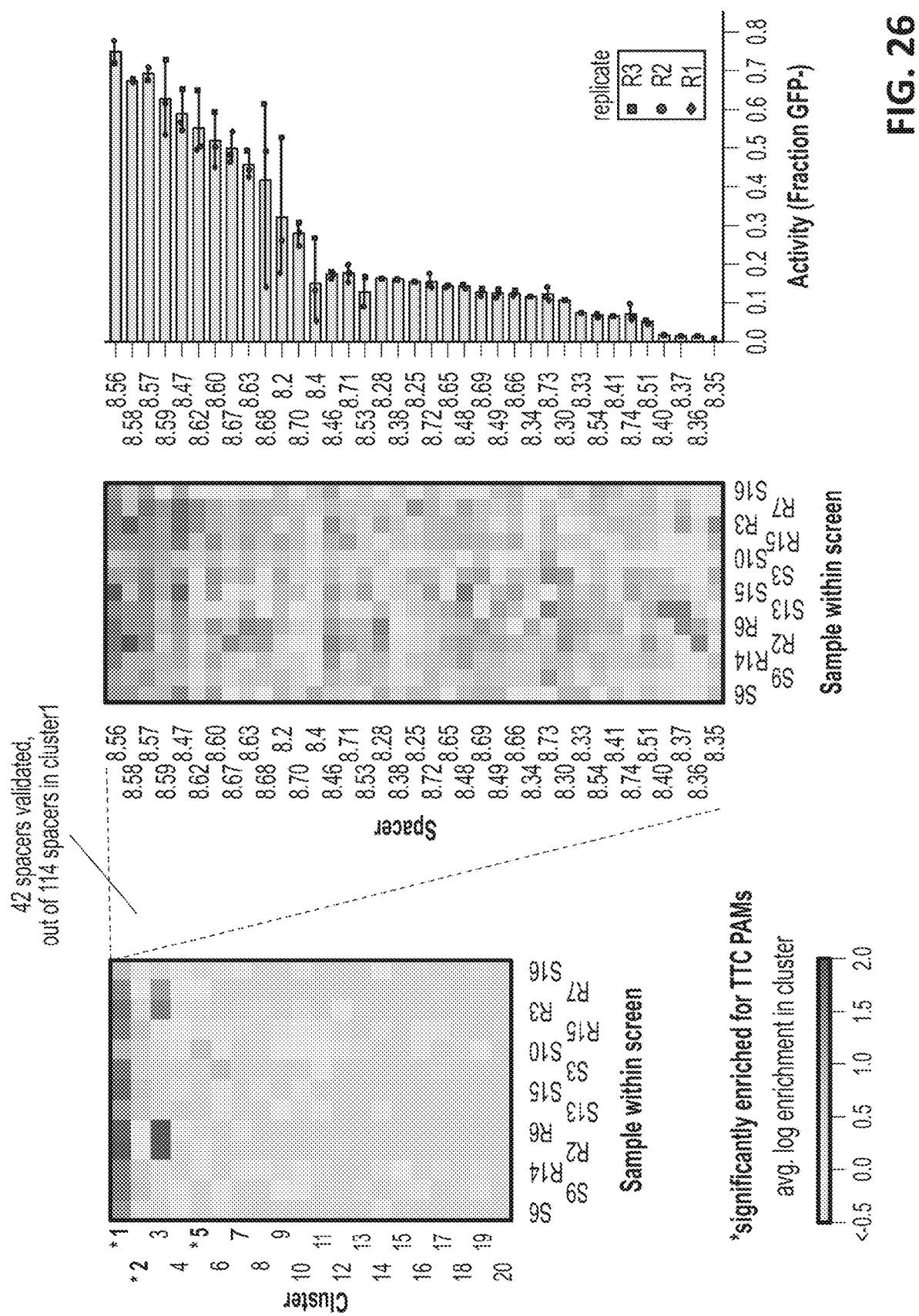
FIG. 26 shows that spacers with improved ability to edit the SOD1 gene can be identified from the screening method described in Example 15.

FIG. 26 shows that spacers with improved ability to edit the SOD1 gene can be identified from the screening method described here. Approximately 5000 different spacers, designed as described in SOD1-modifying spacer selection process were assessed for activity in the SOD1-GFP reporter cell line. The left panel shows that unbiased clustering of the spacers by activity, as described in Methods for NGS analysis of spacer hits across 13 different measurements results in 20 distinct clusters, with cluster 1 containing the most active spacers. 42 of these most active spacers are shown in the middle panel, ranked from top to bottom by activity. The right panel shows that the most active spacers identified in the spacer screen indeed maintain their activity when individually tested via lipofection of CasX construct 119 with scaffold 174 and the respective spacers in the SOD1-GFP cell line.

Conclusions: This example demonstrates that CasX constructs can edit the SOD1 locus in multiple mammalian cell lines. A CasX variant, 119 with guide 64, was found to edit 35-fold better than the previous CasX 2 (SEQ ID NO:2) and guide 2 (SEQ ID NO:5) in some instances, indicating that CasX variants can be designed with improved editing capabilities.

Example 16: Generation and Assay of AAV Vectors Delivering CasX Constructs Targeting SOD1

This example describes a typical protocol followed to produce and characterize AAV2 vectors packaging CasX molecules and guides.

Figure 27:
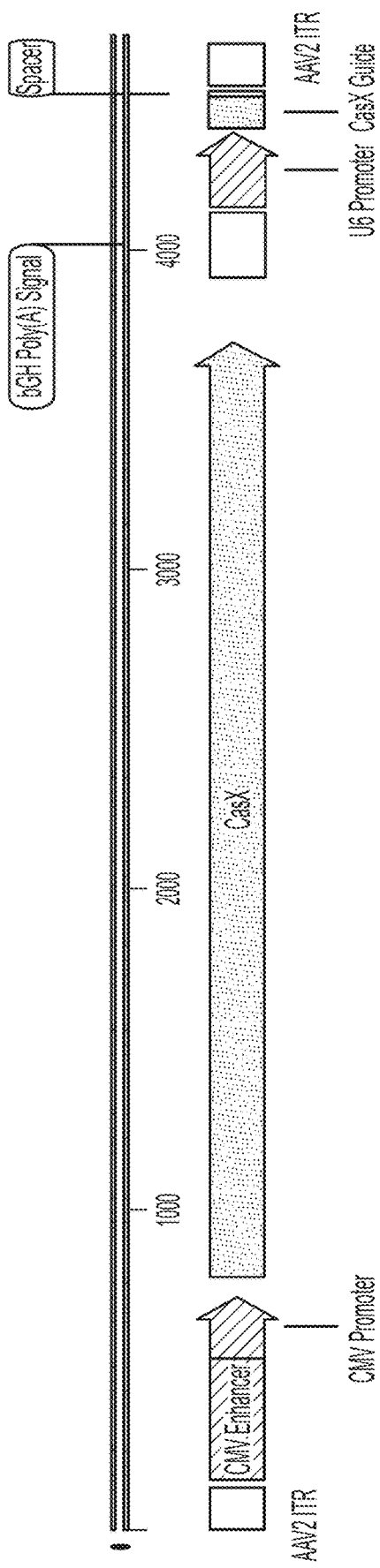
FIG. 27 is a schematic showing an example of CasX protein and scaffold DNA sequence for packaging in adeno-associated virus (AAV), as described in Example 16.

Materials and Methods:

For AAV production, the tri-plasmid transfection method was used, using three essential plasmids—pTransgene carrying the gene of interest to be packaged in AAV, pRC, and pHelper. DNA encoding CasX and guide RNA were cloned into an AAV transgene cassette, between the ITRs (FIG. 27) to generate the pTransgene plasmid. The DNA segment between the AAV inverted terminal repeats (ITRs), comprised of a CasX-encoding DNA and its promoter, and scaffold-encoding DNA and its promoter gets packaged within an AAV capsid during AAV production. The constructed transgene plasmid was verified via full-length plasmid sequencing (see Table 14), restriction digestion, and functional tests including in vitro transfection of mammalian cells. Additional plasmids required for AAV production (pRC plasmid and pHelper plasmid) were purchased from commercial suppliers (Aldevron, Takara).

For AAV production, HEK293/T cells were cultured in FB medium in a 37° C. incubator with 5% CO2. 10-20 15 cm dishes of HEK293T cells were used in a single batch of viral production. For a single 15 cm dish, 15 ug of each plasmid was first mixed together in 4 ml of FB medium, and complexed with 145 ug polyethyleneimine (PEI) i.e., at 3 ug PEI/ug of DNA, for 10 mins at room temperature. The ratio of the three plasmids used may be varied to further optimize virus production as needed.

The PEI-DNA complex was then slowly dripped onto the 15 cm plate of HEK293T cells, and the plate of transfected cells moved back into the incubator. The next day, the medium was changed to FB with 2% FBS (instead of 10% FBS). At 3 days post-transfection, the media from the cells may be collected to increase virus yields. At 5-6 days post-transfection medium and cells were collected. The timing of harvest may be further varied to optimize virus yield.

The cells were pelleted by centrifugation, and the medium collected from the top. Cells were lysed in a buffer with high salt content and high-salt-active nuclease for 1h at 37° C. The cells may also be lysed using additional methods, such as sequential freeze-thaw, or chemical lysis by detergent.

The medium collected at harvest, and any medium collected at earlier time points, were treated with a 1:5 dilution of a solution containing 40% PEG8000 and 2.5M NaCl, and incubated on ice for 2h, in order to precipitate AAV. The incubation may also be carried out overnight at 4° C.

The AAV precipitate from the medium was pelleted by centrifugation, resuspended in high salt content buffer with high-salt-active nuclease and combined with the lysed cell pellet. The combined cell lysate was then clarified by centrifugation and filtration through a 0.45 um filter, and purified on an AAV Poros affinity resin column (Thermofisher Scientific). The virus was eluted from the column into a neutralizing solution. At this stage, the virus may be taken through additional rounds of purification to increase the quality of the virus preparation.

The eluted virus was then titered via qPCR to quantify the virus yield. For titering, a sample of virus was first digested with DNAse to remove any non-packaged viral DNA, the DNAse deactivated, and then viral capsids disrupted with Proteinase K to expose the packaged viral genomes for titering.

Figure 28:
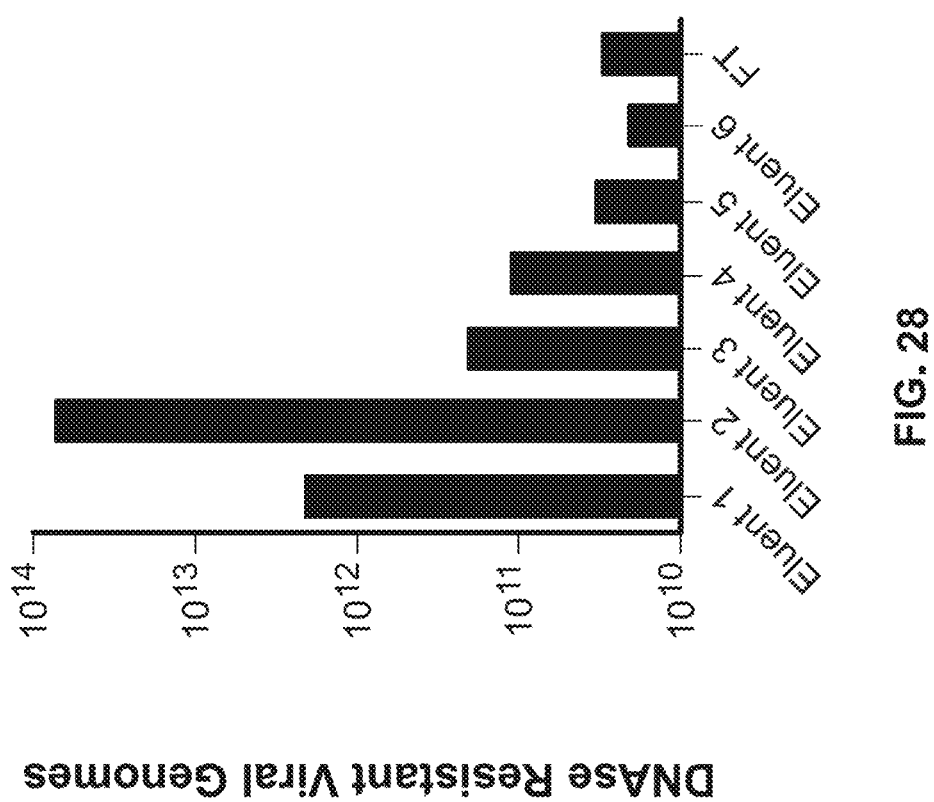
FIG. 28 is a graph showing representative results of AAV titering by qPCR, as described in Example 16.

Results:

Representative titers for AAV packaging DNA encoding a CasX 119 molecule and rRNA guide 64 (119.64) with a spacer having the sequence ATGTTCATGAGTTTGGAGAT (SEQ ID NO: 310) is shown in FIG. 28. During AAV purification, flow through (FT) and consecutive eluent fractions (1-6) are collected and titered by qPCR. Most virus, ~$1\times10^{14}$ viral genomes in this example, is found in the second elution fraction. Typically, ~$1\times10^{12}$ viral genomes were obtained from one batch of virus production as described here.

Conclusion: This example demonstrates that i) CasX and a gNA can be cloned into an AAV transgene construct, and ii) CasX and guide can be packaged in an AAV vector and produced at sufficiently high titers.

TABLE 14

| Plasmid Sequence | |
| --- | --- |
| Construct | DNA sequence |
| pStX17 | (SEQ ID NO: 367) |

Example 17: Administration of AAV Vectors Encoding a CasX System In Vitro and Evidence of SOD1 Gene Editing Materials and Methods:

SOD1-GFP reporter cells were seeded at 30 k cells/well in a 96 well plate in 100u1 of FB medium. Confluence of cells was checked the next day, and cells were transduced at 80% confluence with AAV vectors. CasX 119 molecule and rRNA guide 64 (119.64) with SOD1 targeting spacer (2, with an encoding sequence of ATGTTCATGAGTTTG-GAGAT (SEQ ID NO: 310)) and SauCas9 with SOD1 targeting spacer were packaged in AAV vectors and used to transduce SOD1-GFP reporter cells at a range of different multiplicity of infection (MOIs, no. of viral genomes/cell), for example from 1 to $1\times10^7$ viral genomes per cell. In a separate experiment, neural progenitor cells from the G93A mouse model of ALS (G93A NPCs) were similarly transduced. NPCs are cultured in NPC medium (DMEMF12 with Glutamax, supplemented with 10 mM Hepes (100× Thermofisher #15630080), non-essential amino acids (100× Thermofisher #11140050), penicillin-streptomycin (100x-Pen-Strep; GIBCO #15140-122), 2-mercaptoethanol 1000× (Thermofisher #21985023), B27 without vitamin-A (50x, Thermofisher), N2 (100x, Thermofisher), 20 ng/ml bFGF (Biolegend Cat no #579606), and 20 ng/ml EGF (Thermofisher #PHG0311)) at 37° C. and 5% CO2. The AAV doses were calculated based on viral titers determined by qPCR. Fresh FB medium or NPC medium may be replenished the next day, or as needed. Starting at 5 days post-transduction, and weekly thereafter, a portion of the cells were analyzed via flow cytometry or T7E1 assay.

In a second AAV-mediated gene editing in the SOD1-GFP reporter cell line, CasX 119 molecule and rRNA guide 64 (119.64) with SOD1 targeting spacer (2, with an encoding sequence of ATGTTCATGAGTTTGGAGAT (SEQ ID NO: 310)) and SauCas9 with SOD1 targeting spacer were packaged in AAV vectors and used to transduce SOD1-GFP reporter cells at a range of different multiplicity of infection (MOIs, no. of viral genomes/cell). Twelve days later, cells were assayed for GFP disruption via FACS.

Another AAV-mediated gene editing experiment was conducted in neural progenitor cells (NPCs) from the G93A mouse model of ALS. CasX 119 molecule and rRNA guide 64 (119.64) with SOD1 targeting spacer (2, with an encoding sequence of ATGTTCATGAGTTTGGAGAT (SEQ ID NO: 310)) was packaged in an AAV vector and used to transduce G93A NPCs at a range of different multiplicity of infection (MOIs, no. of viral genomes/cell). Twelve days later, cells were assayed for gene editing via T7E1 assay.

Figure 29:
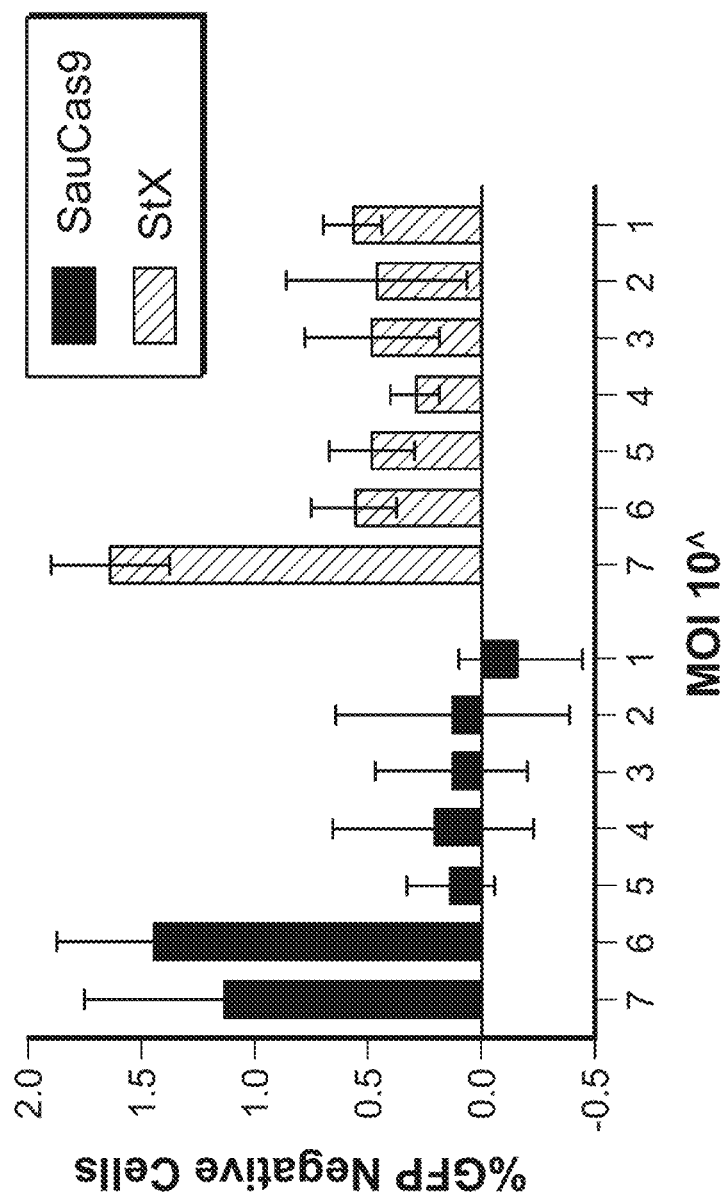
FIG. 29 shows the results of AAV-mediated gene editing in the SOD1-GFP reporter cell line, as described in Example 17.
Figure 30:
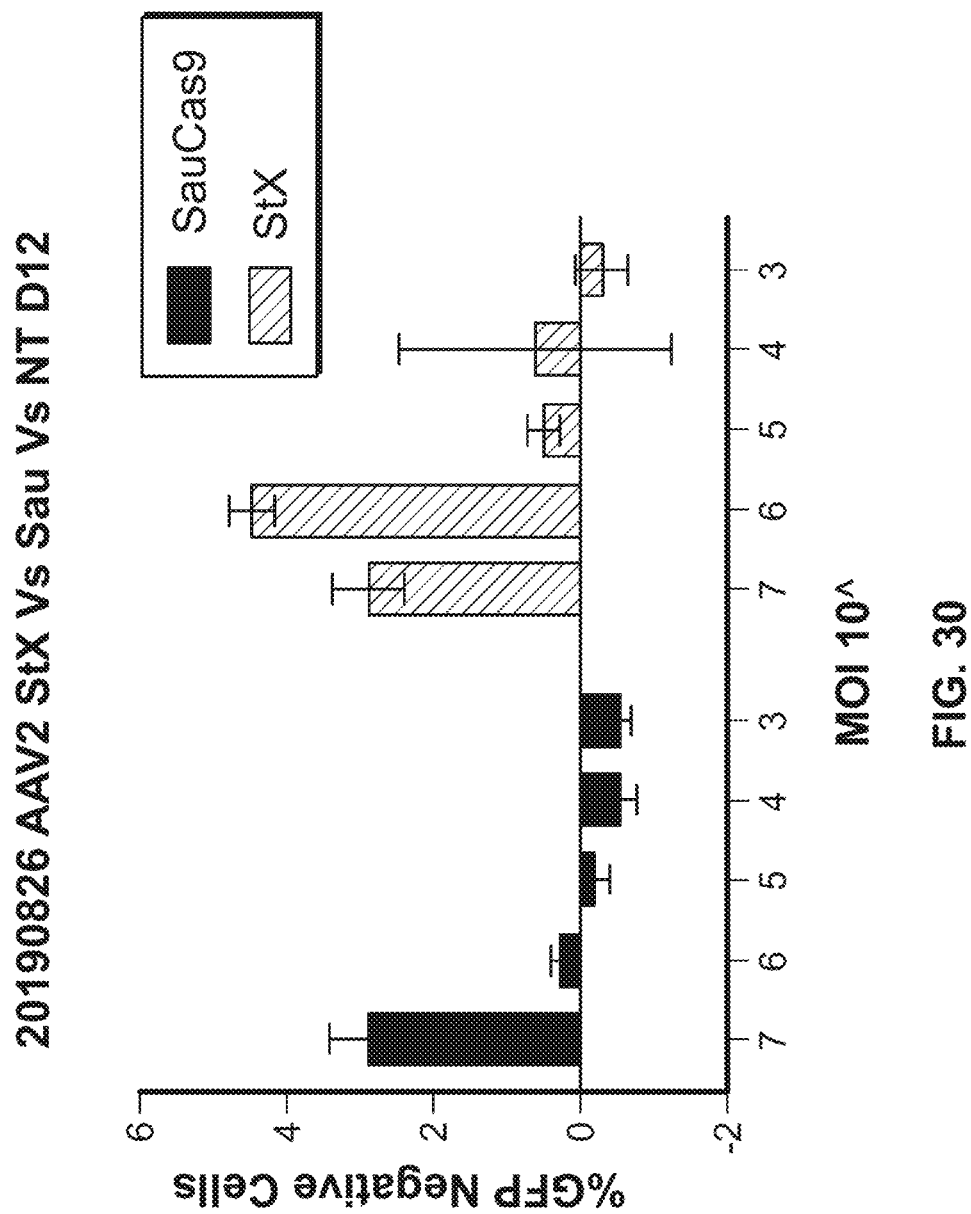
FIG. 30 shows the results of second AAV-mediated gene editing example in the SOD1-GFP reporter cell line, as described in Example 17.

Results:

A representative example of SOD1 editing, as demonstrated by percentage of GFP negative cells, at 12 days post-transduction is shown in FIG. 29 and FIG. 30.

Figure 31:
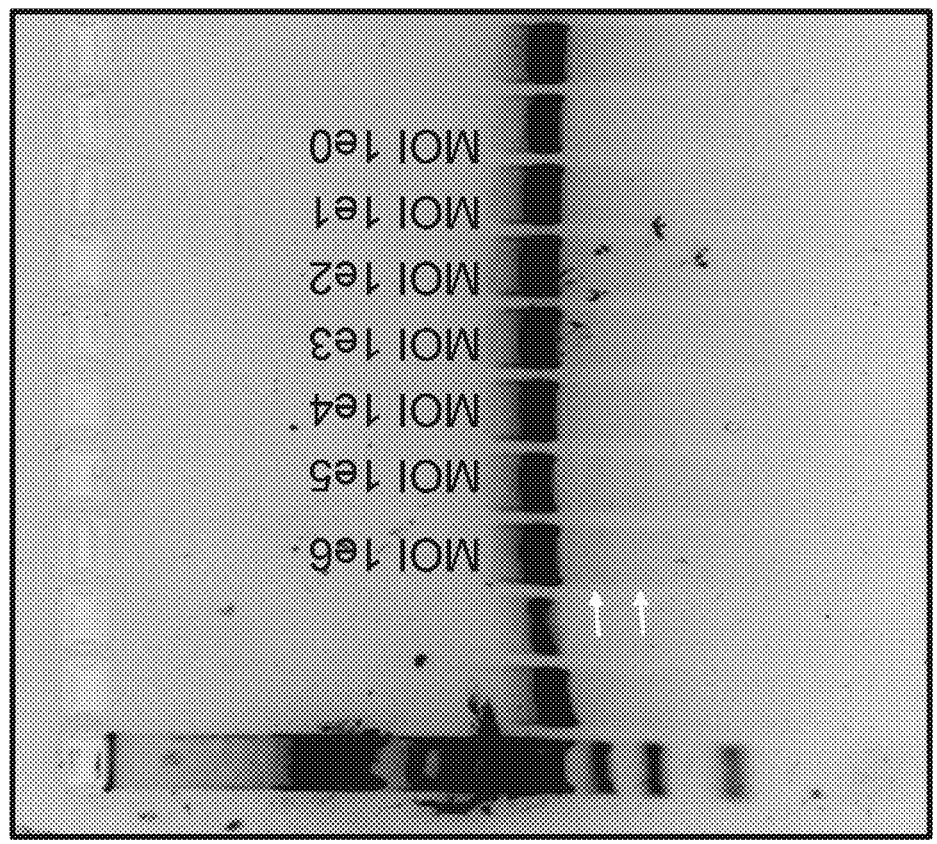
FIG. 31 shows an agarose gel image from the T7E1 assay, demonstrating successful editing of the SOD1 locus by CasX delivered via AAV, as described in Example 17.

Twelve days later, cells were assayed for GFP disruption via FACS. In this example, CasX and SauCas9 shows equivalent levels of editing, where 1-2% of the cells show GFP disruption at the highest MOIs, $1\times10^7$ or $1\times10^6$ (FIG. 29). In FIG. 30, CasX and SauCas9 shows equivalent levels of editing at the highest MOI, where ~2-4% of the cells show GFP disruption. FIG. 31 shows an agarose gel image from the T7E1 assay, demonstrating successful editing of the SOD1 locus by CasX delivered via AAV. Double arrows show the two DNA bands as a result of successful editing of the SOD1 locus in G93A NPCs.

Conclusion: This example demonstrates that CasX constructs targeting SOD1 may be delivered to mammalian cells via AAV, and result in successful editing of the SOD1 locus.

Example 18: Demonstrating Allele-Specific Editing at the A4V SOD1 Locus

The purpose of this example was to demonstrate the proof-of-concept ability of CasX:gNA systems to edit the SOD1 gene at the A4V locus in an allele-specific manner. In order to generate SOD1 targeting constructs, SOD1 targeting spacers were cloned into a base mammalian-expression plasmid construct (pStX34) that is comprised of the following components: codon-optimized CasX (construct 119; see Example 2)+NLS; guide scaffold, and a mammalian selection marker, puromycin. The spacer sequence DNA (WT CasX SOD1 spacer 8.88, having the sequence GCACGCACACGGCCTTCGTC (SEQ ID NO: 368) and CasX A4V spacer 8.89 having the sequence GCACGCACACGACCTTCGTC (SEQ ID NO: 369)) was ordered as single-stranded DNA (ssDNA) oligos from Integrated DNA Technologies (IDT), consisting of the spacer sequence and the reverse complement of this sequence. These two oligos were annealed together and cloned into pStX individually or in bulk by Golden Gate Assembly using T4 DNA Ligase (New England BioLabs Cat #M0202L) and an appropriate restriction enzyme for the plasmid. Assembled products were transformed into chemically- or electro-competent bacterial cells, plated on LBb-Agar plates (LB: Teknova Cat #L9315, Agar: Quartzy Cat #214510) containing carbenicillin. Individual colonies were picked and miniprepped using Qiagen Qiaprep® spin Miniprep Kit (Qiagen Cat #27104) following the manufacturer's protocol. The resultant plasmids were sequenced using Sanger sequencing to ensure correct ligation. One strategy to permanently treat SOD1-related ALS is to specifically disrupt the mutant copy of the gene with the A4V mutation while sparing the WT allele. SOD1-GFP cells with both wild-type alleles should be editable by the WT CasX spacer (8.88, having the RNA sequence GCACGCACACGGCCUUCGUC (SEQ ID NO: 370)), but not by the mutant CasX spacer (8.89 having the RNA sequence GCACGCACACGACCUUCGUC (SEQ ID NO: 371)). This example additionally demonstrates the ability of CasX spacers to distinguish between on-target and off-target alleles that differ by a single nucleotide. SOD1-GFP cells were seeded at 20 -40 k cells/well in a 96 well plate in 100 pl of FB medium and cultured in a 37° C. incubator with 5% CO2. The following day, confluence of seeded cells was checked to ensure that cells were at ~75% confluence at time of transfection. If cells were at the right confluence, transfection was carried out. Each CasX and guide construct (e.g., CasX 119 with guide 174) was transfected into the SOD1-GFP cells at 100-500 ng per well using Lipofectamine™ 3000 following the manufacturer's protocol, using 3 wells per construct as replicates. A non-targeting plasmid was used as a negative control. Cells were selected for successful transfection with puromycin at 0.3-3 µg/ml for 24-48 hours followed by 24-48 hours of recovery in FB medium. Editing was analyzed by measuring the fraction of cells expressing the reporter protein, GFP, via flow cytometry.

Figure 32:
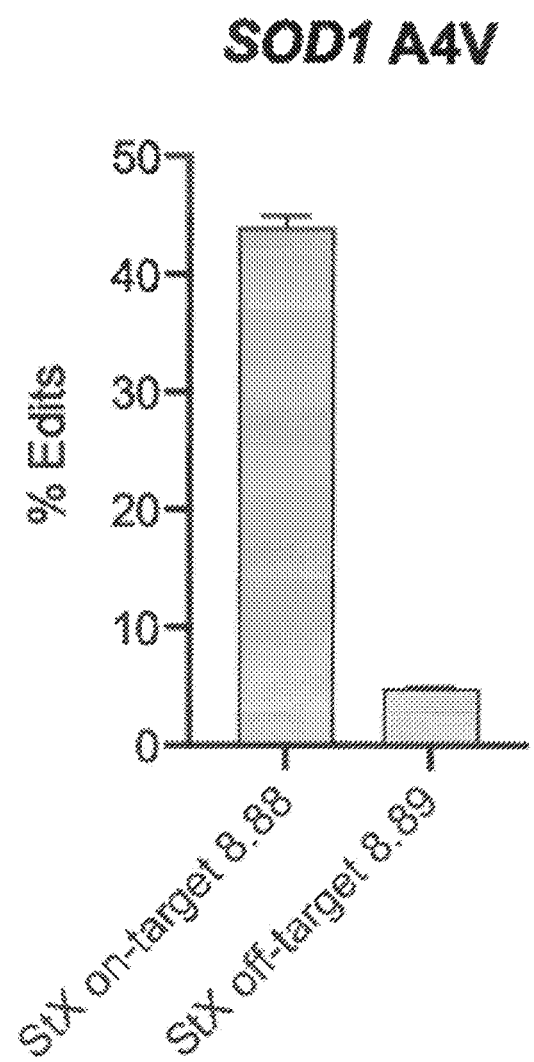
FIG. 32 shows results from a flow cytometry assay, as described in Example 18.

Results: As shown in FIG. 32, flow cytometry demonstrated that the CasX 119, guide 174 and spacer 8.88 construct was able to edit the WT SOD1 locus in SOD1-GFP cells when targeted to the A4 locus using a spacer that targets the WT sequence (on-target). A CasX construct with spacer 8.89 that targets the mutant sequence (off-target), was not able to edit the WT locus with significantly lower efficiency.

Conclusion: This example demonstrates that CasX with an appropriate guide and spacer is able to edit the A4 SOD1 locus in an allele-specific manner.

Example 19: Evaluation of SOD1 Gene Editing in Mouse Model of ALS

The purpose of the examples will be to evaluate the efficacy of CasX:gNA systems used to edit SOD1 mutations in an established mouse model of ALS.

Experimental design: T test article will be evaluated using transgenic overexpressing G93A mutant SOD1 mice. Time pregnant mice (both G93A mutants and wild-type controls) will be purchased from Jackson Labs. Upon receipt, mice will be single housed in OptiMice ventilated racks and acclimated prior to use. On the day of dosing, animals are anesthetized via cryoanesthesia and dosed ICV with a dose volume of 1 µl/g or no more than 2 µl of solution. A micro-liter calibrated sterilized glass micropipette is used that is attached to a 10 uL Hamilton syringe. The needle tip is adjusted to correct length for a 2 mm penetration into the skull. The immobilized mouse is firmly grasped by the skin behind the head. A fiber optic light is used to illuminate relevant anatomical structures used as a guide. The needle will penetrate, perpendicularly, 2 mm into the skull, for ICV at a location approximately 0.25 mm lateral to the sagittal suture and 0.50-0.75 mm rostral to the neonatal coronary suture. Dosing solution will be dispensed slowly (about 1 µl/sec). Body weights will be measured twice a week throughout the study.

Clinical Scoring: Mice will be scored for disease progression twice a week and then daily after 15 weeks of age according to the following scale:

Stage 0: No symptoms;

Stage 1: Body tremor, leg tremor, spiked fur, slowed locomotor behavior. Mouse will look generally un-groomed and slightly weak. Normal righting reflex Stage 2: Hind limb dragging, paw curling, ataxia, slower righting reflex, hind limb splay, stage 1 symptoms.

Stage 3: Hind limb paralysis, hair loss, slightly emaciated, lack of rearing ability, delayed righting reflex, stage 2 symptoms.

Stage 4: Unable to walk and lying on side, hunched back, paralysis of 2 or more limbs, emaciated, delayed righting reflex, prolapsed penis, stage 3 symptoms.

Mice that are unable to right within 30 sec, mouse will be euthanized.

Grip Strength: Grip strength is used to assess muscular strength in limb muscles. Mice are held by the tail and lowered towards the mesh grip piece on the push-pull gauge (San Diego Instruments, San Diego, Calif.) until the animal grabs with both front paws. The animal is lowered toward the platform and gently pulled backwards with consistent force by the experimenter until it releases its grip. The forelimb grip force is recorded on the strain gauge. The experimenter continues to pull the animal backwards along the platform until the animal's hind paws grab the mesh grip piece on the push-pull gauge. The animal is gently pulled backwards with consistent force by the experimenter until it releases its grip. The hind limb grip force is recorded on the strain gauge. After testing animals are placed back into the test or home cage. Grip strength commences when mice are 5 weeks of age and is measured every other week until mice are not able to perform task.

Rotarod: Motor coordination will be assessed by rotarod. Mice will be placed on a constant speed rotating rod (4 rpm) followed by 2 trials on an accelerating rotating rod (4-28 rpm). The time it takes the mice to fall in each of the trials is recorded. The duration of each trial is 3 min. After rotarod testing animals are placed back into the home cage. Rotarod test commences when mice are 5 weeks of age and resumes every other week until animals are not able to perform CMAP: Mice will be anesthetized by isoflurane/02 sufficient anesthesia by testing simple reflexes such as movement reflexes or testing of sensitivity for low-grade pain. Hair will be removed from the hind limb. Skin will be cleaned with alcohol to remove any dirt and body oil. Body temperature will be maintained by a feedback controlled heating plate and rectal thermo probe. Place loop electrodes using contact gel for optimal conductivity/transfer resistance are placed at the position where the gastrocnemius muscle has its maximum diameter. The reference electrode is placed just beneath the effective electrode. Leads will be connected to the EMG machine (Nicolet Viking Quest, Natus Neurology, Middleton, Mich., USA). Five responses evoked by stimulation will be averaged to generate a smooth compound muscle action potential (CMAP). Then the amplitude and the onset latency will be measured based on the averaged CMAPs. Nerve conduction velocity (NCV) can be calculated from the response latency and the distance from stimulating electrode to recording electrode. For MUNE calculation, a maximum CMAP is obtained first by increasing stimulating intensity until the response no longer increases. Then the average single motor unit potential (SMUP) is determined using incremental stimulation technique. Starting from an all-or-none response, 10 increments will be summed and averaged. Then the maximum CMAP will be divided by average SMUP to obtain MUNE number. CMAP and MUNE will be measured at 5 weeks, 9, 13, 17, 20 weeks of age.

Righting Reflex and survival: Righting reflex is used as a surrogate for survival. The animal is simply placed on its back on a flat surface and the time taken to right itself is measured (up to 0.5 min). Only one trial per mouse at each time point is performed. Righting reflex testing will commence when mice are 15 weeks of age and will be performed daily until the mice can no longer right themselves. Mice will be euthanized if no longer able to right themselves.

At the end of each study period, mice are decapitated and trunk blood is collected in microcentrifuge tubes containing EDTA and kept on ice for short term storage. Within 15 minutes the tubes are centrifuged in a refrigerated centrifuge. Plasma is extracted and samples are stored in the −80° C. freezer for future analyses. Brains will be removed and frozen on dry ice. Samples will be stored at −80° C. freezer for future histopathology or other analyses. Spinal Cord: After the removal of the brain, the spinal cord is extracted. A 3 ml syringe attached to a 200 μl pipette tip is filled with saline and used for spinal cord flushing. The pelvic region is cut horizontally so the spinal column could be visible. Once the pelvic area is cut, the pipette tip is inserted through the small opening visible at the base of the spinal column and the spinal cord is flushed out. The whole spinal cord is frozen in pre-chilled Eppendorf tubes on dry ice. Samples are stored in the −80° C. freezer for future histopathology or other analyses.

Results: The data from the example are expected to provide information on the efficacy of the CasX:gNA to prevent or ameliorate ALS conditions in the mouse model.

SEQUENCE LISTING (12496 sequences)

SEQ ID NO: 1 - protein, 986 aa, Unknown
  Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, Unknown
  Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, Unknown
  Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, Artificial Sequence
  reference sgRNA
acaucuggcgcguuuauuccauuacuuuggagccagucccagcgacuaugucguauggacgaagcgcuuauuuaucggagagaaaccgauaaguaaaacgcaucaaag

SEQ ID NO: 5 - RNA, 108 nt, Artificial Sequence
  reference sgRNA
uacuggcgcuuuuaucucauuacuuugagagccaucaccagcgacuaugucguauggguaaagcgcuuauuuaucggagagaaauccgauaaauaagaagcaucaaag

SEQ ID NO: 6 - RNA, 81 nt, Unknown
  Deltaproteobacteria sp.
acaucuggcgcguuuauuccauuacuuuggagccagucccagcgacuaugucguauggacgaagcgcuuauuuaucggaga

SEQ ID NO: 7 - RNA, 78 nt, Unknown
  Deltaproteobacteria sp.
acaucuggcgcguuuauuccauuacuuuggagccagucccagcgacuaugucguauggacgaagcgcuuauuuaucgg

SEQ ID NO: 8 - RNA, 80 nt, Unknown
  Planctomycetes sp.
uacuggcgcuuuuaucucauuacuuugagagccaucaccagcgacuaugucguauggguaaagcgcuuauuuaucggaga

SEQ ID NO: 9 - RNA, 77 nt, Unknown
  Planctomycetes sp.
uacuggcgcuuuuaucucauuacuuugagagccaucaccagcgacuaugucguauggguaaagcgcuuauuuaucgg

SEQ ID NO: 10 - RNA, 25 nt, Unknown
  Candidatus Sungbacteria sp.
guuuacacacucccucucauagggu

SEQ ID NO: 11 - RNA, 25 nt, Unknown
  Candidatus Sungbacteria sp.
guuuacacacucccucucaugaggu

SEQ ID NO: 12 - RNA, 25 nt, Unknown
  Candidatus Sungbacteria sp.
uuuuacauacccccucucaugggau

SEQ ID NO: 13 - RNA, 25 nt, Unknown
  Candidatus Sungbacteria sp.
guuuacacacucccucucauggggg

SEQ ID NO: 14 - RNA, 20 nt, Artificial Sequence
  reference sgRNA
ccagcgacuaugucguaugg

SEQ ID NO: 15 - RNA, 39 nt, Artificial Sequence
  reference sgRNA
gcgcuuauuuaucggagagaaauccgauaaauaagaagc

SEQ ID NO: 16 - RNA, 74 nt, Artificial Sequence
  reference sgRNA
ggcgcuuuuaucucauuacuuugagagccaucaccagcgacuaugucguauggguaaagcgcuuauuuaucgga

SEQ ID NO: 17 - RNA, 21 nt, Artificial Sequence
  stem loop sequence
  misc_feature (4)..(18): n is any ribonucleotide
  misc_feature (8)..(18): These individual nucleotides may be absent
uuunnnnnnnnnnnnnnnuuu

SEQ ID NO: 18 - RNA, 23 nt, Unknown
  Deltaproteobacteria sp.
ccgauaaguaaaacgcaucaaag

SEQ ID NO: 19 - RNA, 26 nt, Unknown
  Planctomycetes sp.
ucuccgauaaauaagaagcaucaaag

SEQ ID NO: 20 - RNA, 21 nt, Artificial Sequence
  scaffold stem loop
ccagcgacuaugucguagugg

SEQ ID NO: 21 - RNA, 31 nt, Artificial Sequence
  stem loop sequence
  misc_feature (4)..(28): n is any ribonucleotide
  misc_feature (8)..(28): These individual nucleotides may be absent
uuunnnnnnnnnnnnnnnnnnnnnnnnnuuu

SEQ ID NO: 22 - RNA, 19 nt, Unknown
  exogenous stem loop region
acaugaggauuacccaugu

SEQ ID NO: 23 - RNA, 18 nt, Unknown
  exogenous stem loop region
ugcaugucuaagacagca

SEQ ID NO: 24 - RNA, 20 nt, Unknown
  exogenous stem loop region
aauccauugcacuccggauu

SEQ ID NO: 25 - RNA, 12 nt, Unknown
  exogenous stem loop region
ccucuucggagg

SEQ ID NO: 26 - RNA, 21 nt, Unknown
  exogenous stem loop region
aggaguuucuauggaaacccu

SEQ ID NO: 27 - RNA, 30 nt, Unknown
  exogenous stem loop region
aggugggacgaccucucggucguccuaucu

SEQ ID NO: 28 - RNA, 19 nt, Unknown
  exogenous stem loop region
ugcucgcuccguucgagca

SEQ ID NO: 29 - RNA, 21 nt, Unknown
  exogenous stem loop region
ugcucgacgcguccucgagca

SEQ ID NO: 30 - RNA, 22 nt, Unknown
  exogenous stem loop region
ugcucguuugcggcuacgagca

SEQ ID NO: 31 - RNA, 17 nt, Unknown
  exogenous stem loop region
agggagggagggagagg

SEQ ID NO: 32 - RNA, 19 nt, Unknown
  exogenous stem loop region
gguuaggguuaggguuagg

SEQ ID NO: 33 - RNA, 25 nt, Unknown
  exogenous stem loop region
cugcucaguacgagaggaaccgcag

SEQ ID NO: 34 - RNA, 78 nt, Unknown
  exogenous stem loop region
uacacugggaucgcugaauuagagaucggcguccuuucauucuauauacuuuggaguuuuaaaaugucucuaaguaca

SEQ ID NO: 35 - protein, 4 aa, Unknown
  zinc finger/ribbon domain
  SITE (2)..(3): Xaa is any amino acid
CXXC

SEQ ID NO: 36 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 37 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 38 - protein, 985 aa, Artificial Sequence
  CasX Variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 39 - protein, 986 aa, Artificial Sequence
  CasX Variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 40 - protein, 921 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 41 - protein, 920 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 42 - protein, 977 aa, Artificial Sequence
  CasX Variant
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 43 - protein, 986 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 44 - protein, 925 aa, Artificial Sequence
  CasX Variant
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 45 - protein, 975 aa, Artificial Sequence
  CasX Variant
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 46 - protein, 982 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 47 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 48 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 49 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 50 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 51 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 52 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 53 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 54 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 55 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 56 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 58 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 59 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 60 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 61 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 62 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 63 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 64 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 65 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 66 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 67 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 68 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 69 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 70 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 71 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 72 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 73 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 74 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 75 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 76 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 77 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 78 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 79 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 80 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 81 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 82 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 83 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 84 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 85 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 86 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 87 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 88 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 89 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 90 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 91 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 92 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 93 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 94 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 95 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 96 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 97 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 98 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 99 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 100 - protein, 154 aa, Homo sapiens [sequence omitted]

SEQ ID NO: 101 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 102 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 103 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 104 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 105 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 106 - protein, 977 aa, Artificial Sequence; identical to SEQ ID NO: 59
  CasX Variant

SEQ ID NO: 107 - protein, 977 aa, Artificial Sequence; identical to SEQ ID NO: 59
  CasX Variant

SEQ ID NO: 108 - protein, 977 aa, Artificial Sequence; identical to SEQ ID NO: 59
  CasX Variant

SEQ ID NO: 109 - protein, 977 aa, Artificial Sequence; identical to SEQ ID NO: 59
  CasX Variant

SEQ ID NO: 110 - protein, 977 aa, Artificial Sequence; identical to SEQ ID NO: 59
  CasX Variant

SEQ ID NO: 111 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 112 - protein, 977 aa, Artificial Sequence; identical to SEQ ID NO: 59
  CasX Variant

SEQ ID NO: 113 - protein, 977 aa, Artificial Sequence; identical to SEQ ID NO: 59
  CasX Variant

SEQ ID NO: 114 - protein, 977 aa, Artificial Sequence; identical to SEQ ID NO: 59
  CasX Variant

SEQ ID NO: 115 - protein, 977 aa, Artificial Sequence; identical to SEQ ID NO: 59
  CasX Variant

SEQ ID NO: 116 - protein, 977 aa, Artificial Sequence; identical to SEQ ID NO: 59
  CasX Variant

SEQ ID NO: 117 - protein, 977 aa, Artificial Sequence; identical to SEQ ID NO: 59
  CasX Variant

SEQ ID NO: 118 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 119 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 120 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 121 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 122 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 123 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 124 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 125 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 126 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 127 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 128 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 129 - protein, 986 aa, Artificial Sequence; identical to SEQ ID NO: 43
  CasX Variant

SEQ ID NO: 130 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 131 - protein, 972 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 132 - protein, 84 aa, Unknown
  chloroplast transit peptide
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 133 - protein, 57 aa, Unknown
  chloroplast transit peptide
MASMISSSAVTTVSRASRGQSAAMAPFGGLKSMTGFPVRKVNTDITSITSNGGRVKS

SEQ ID NO: 134 - protein, 85 aa, Unknown
  chloroplast transit peptide
MASSMLSSATMVASPAQATMVAPFNGLKSSAAFPATRKANNDITSITSNGGRVNCMQVWPPIEKKKFETLSYLPDLTDSGGRVNC

SEQ ID NO: 135 - protein, 76 aa, Unknown
  chloroplast transit peptide
MAQVSRICNGVQNPSLISNLSKSSQRKSPLSVSLKTQQHPRAYPISSSWGLKKSGMTLIGSELRPLKVMSSVSTAC

SEQ ID NO: 136 - protein, 76 aa, Unknown
  chloroplast transit peptide
MAQVSRICNGVWNPSLISNLSKSSQRKSPLSVSLKTQQHPRAYPISSSWGLKKSGMTLIGSELRPLKVMSSVSTAC

SEQ ID NO: 137 - protein, 72 aa, Unknown
  chloroplast transit peptide
MAQINNMAQGIQTLNPNSNFHKPQVPKSSSFLVFGSKKLKNSANSMLVLKKDSIFMQLFCSFRISASVATAC

SEQ ID NO: 138 - protein, 69 aa, Unknown
  chloroplast transit peptide
MAALVTSQLATSGTVLSVTDRFRRPGFQGLRPRNPADAALGMRTVGASAAPKQSRKPHRFDRRCLSMVV

SEQ ID NO: 139 - protein, 77 aa, Unknown
  chloroplast transit peptide
MAALTTSQLATSATGFGIADRSAPSSLLRHGFQGLKPRSPAGGDATSLSVTTSARATPKQQRSVQRGSRRFPSVVVC

SEQ ID NO: 140 - protein, 65 aa, Unknown
  chloroplast transit peptide
MESLAATSVFAPSRVAVPAARALVRAGTVVPTRRTSSTSGTSGVKCSAAVTPQASPVISRSAAAA

SEQ ID NO: 141 - protein, 72 aa, Unknown
  chloroplast transit peptide
MGAAATSMQSLKFSNRLVPPSRRLSPVPNNVTCNNLPKSAAPVRTVKCCASSWNSTINGAAATTNGASAASS

SEQ ID NO: 142 - protein, 20 aa, Unknown
  endosomal escape polypeptide
  SITE (4)..(4): Xaa is Lys, His or Arg
  SITE (8)..(8): Xaa is Lys, His or Arg
  SITE (11)..(11): Xaa is Lys, His or Arg
  SITE (15)..(15): Xaa is Lys, His or Arg
  SITE (19)..(19): Xaa is Lys, His or Arg
GLFXALLXLLXSLWXLLLXA

SEQ ID NO: 143 - protein, 20 aa, Unknown
  endosomal escape polypeptide
GLFHALLHLLHSLWHLLLHA

SEQ ID NO: 144 - protein, 9 aa, Unknown
  endosomal escape polypeptide
HHHHHHHHH

SEQ ID NO: 145 - protein, 7 aa, Betapolyomavirus macaca mulatta polyomavirus 1
PKKKRKV

SEQ ID NO: 146 - protein, 16 aa, Unknown
  nuclear localization signal
KRPAATKKAGQAKKKK

SEQ ID NO: 147 - protein, 9 aa, Homo sapiens
PAAKRVKLD

SEQ ID NO: 148 - protein, 11 aa, Homo sapiens
RQRRNELKRSP

SEQ ID NO: 149 - protein, 38 aa, Unknown
  nuclear localization signal
NQSSNFGPMKGGNFGGRSSGPYGGGGQYFAKPRNQGGY

SEQ ID NO: 150 - protein, 42 aa, Unknown
  nuclear localization signal
RMRIZFKNKGKDTAELRRRRVEVSVELRKAKKDEQILKRRNV

SEQ ID NO: 151 - protein, 8 aa, Unknown
  nuclear localization signal
VSRKRPRP

SEQ ID NO: 152 - protein, 8 aa, Unknown
  nuclear localization signal
PPKKARED

SEQ ID NO: 153 - protein, 8 aa, Homo sapiens
PQPKKKPL

SEQ ID NO: 154 - protein, 12 aa, Mus musculus
SALIKKKKKMAP

SEQ ID NO: 155 - protein, 5 aa, Alphainfluenzavirus influenza A virus
DRLRR

SEQ ID NO: 156 - protein, 7 aa, Alphainfluenzavirus influenza A virus
PKQKKRK

SEQ ID NO: 157 - protein, 10 aa, Deltavirus  hepatitis delta virus
RKLKKKIKKL

SEQ ID NO: 158 - protein, 10 aa, Mus musculus
REKKKFLKRR

SEQ ID NO: 159 - protein, 20 aa, Homo sapiens
KRKGDEVDGVDEVAKKKSKK

SEQ ID NO: 160 - protein, 17 aa, Homo sapiens
RKCLQAGMNLEARKTKK

SEQ ID NO: 161 - protein, 8 aa, Orthobornavirus mammalian 1 orthobornavirus
PRPRKIPR

SEQ ID NO: 162 - protein, 9 aa, Hepacivirus  hepacivirus C
PPRKKRTVV

SEQ ID NO: 163 - protein, 12 aa, Unknown
  nuclear localization signal
NLSKKKKRKREK

SEQ ID NO: 164 - protein, 10 aa, Unknown
  nuclear localization signal
RRPSRPFRKP

SEQ ID NO: 165 - protein, 8 aa, Lymphocryptovirus human gammaherpesvirus 4
KRPRSPSS

SEQ ID NO: 166 - protein, 19 aa, Alphainfluenzavirus influenza A virus
KRGINDRNFWRGENERKTR

SEQ ID NO: 167 - protein, 11 aa, Homo sapiens
PRPPKMARYDN

SEQ ID NO: 168 - protein, 8 aa, Unknown
  nuclear localization signal
KRSFSKAF

SEQ ID NO: 169 - protein, 9 aa, Unknown
  nuclear localization signal
KLKIKRPVK

SEQ ID NO: 170 - protein, 19 aa, Unknown
  nuclear localization signal
PKKKRKVPPPPAAKRVKLD

SEQ ID NO: 171 - protein, 17 aa, Deltaretrovirus human T-lymphotropic virus 1
PKTRRRPRRSQRKRPPT

SEQ ID NO: 172 - protein, 24 aa, Caenorhabditis elegans
SRRRKANPTKLSENAKKLAKEVEN

SEQ ID NO: 173 - protein, 16 aa, Unknown
  nuclear localization signal
KTRRRPRRSQRKRPPT

SEQ ID NO: 174 - protein, 13 aa, Unknown
  nuclear localization signal
RRKKRRPRRKKRR

SEQ ID NO: 175 - protein, 14 aa, Unknown
  nuclear localization signal
PKKKSRKPKKKSRK

SEQ ID NO: 176 - protein, 17 aa, Unknown
  nuclear localization signal
HKKKHPDASVNFSEFSK

SEQ ID NO: 177 - protein, 18 aa, Unknown
  nuclear localization signal
QRPGPYDRPQRPGPYDRP

SEQ ID NO: 178 - protein, 16 aa, Unknown
  nuclear localization signal
LSPSLSPLLSPSLSPL

SEQ ID NO: 179 - protein, 18 aa, Unknown
  nuclear localization signal
RGKGGKGLGKGGAKRHRK

SEQ ID NO: 180 - protein, 14 aa, Unknown
  nuclear localization signal
PKRGRGRPKRGRGR

SEQ ID NO: 181 - protein, 19 aa, Unknown
  nuclear localization signal
PKKKRKVPPPPAAKRVKLD

SEQ ID NO: 182 - protein, 17 aa, Unknown
  nuclear localization signal
PKKKRKVPPPPKKKRKV

SEQ ID NO: 183 - protein, 11 aa, Human immunodeficiency virus 1
YGRKKRRQRRR

SEQ ID NO: 184 - protein, 8 aa, Human immunodeficiency virus 1
RKKRRQRR

SEQ ID NO: 185 - protein, 11 aa, Human immunodeficiency virus 1
YARAAARQARA

SEQ ID NO: 186 - protein, 11 aa, Human immunodeficiency virus 1
THRLPRRRRRR

SEQ ID NO: 187 - protein, 11 aa, Human immunodeficiency virus 1
GGRRARRRRRR

SEQ ID NO: 188 - protein, 50 aa, Artificial Sequence
  peptide transduction domain
  SITE (4)..(50): These individual amino acid residues may be present or absent
RRRRRRRRRRRRRRRRRRRRRRRRRRRRRRRRRRRRRRRRRRRRRRRRRR

SEQ ID NO: 189 - protein, 12 aa, Artificial Sequence
  peptide transduction domain
RRQRRTSKLMKR

SEQ ID NO: 190 - protein, 27 aa, Artificial Sequence
  peptide transduction domain
GWTLNSAGYLLGKINLKALAALAKKIL

SEQ ID NO: 191 - protein, 33 aa, Artificial Sequence
  peptide transduction domain
KALAWEAKLAKALAKALAKHLAKALAKALKCEA

SEQ ID NO: 192 - protein, 16 aa, Artificial Sequence
  peptide transduction domain
RQIKIWFQNRRMKWKK

SEQ ID NO: 193 - protein, 5 aa, Artificial Sequence
  linker polypeptide
GSGGS

SEQ ID NO: 194 - protein, 6 aa, Artificial Sequence
  linker polypeptide
GGSGGS

SEQ ID NO: 195 - protein, 4 aa, Artificial Sequence
  linker polypeptide
GGGS

SEQ ID NO: 196 - protein, 4 aa, Artificial Sequence
  linker polypeptide
GGSG

SEQ ID NO: 197 - protein, 5 aa, Artificial Sequence
  linker polypeptide
GGSGG

SEQ ID NO: 198 - protein, 5 aa, Artificial Sequence
  linker polypeptide
GSGSG

SEQ ID NO: 199 - protein, 5 aa, Artificial Sequence
  linker polypeptide
GSGGG

SEQ ID NO: 200 - protein, 5 aa, Artificial Sequence
  linker polypeptide
GGGSG

SEQ ID NO: 201 - protein, 5 aa, Artificial Sequence
  linker polypeptide
GSSSG

SEQ ID NO: 202 - protein, 4 aa, Artificial Sequence
  linker polypeptide
GPGP

SEQ ID NO: 203 - protein, 6 aa, Artificial Sequence
  linker polypeptide
PPAPPA

SEQ ID NO: 204 - protein, 7 aa, Artificial Sequence
  linker polypeptide
PPPGPPP

SEQ ID NO: 205 - protein, 25 aa, Unknown
  nuclear localization signal
MSRRRKANPTKLSENAKKLAKEVEN

SEQ ID NO: 206 - DNA, 3120 bp, Artificial Sequence
  CasX variant Stx2
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcttccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcagccaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgccgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaaaaaactgaaagaggtctggaaaccggcggtagcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 207 - DNA, 3123 bp, Artificial Sequence
  CasX variant 119
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 208 - protein, 976 aa, Artificial Sequence; identical to SEQ ID NO: 105
  CasX variant 119

SEQ ID NO: 209 - DNA, 2928 bp, Artificial Sequence
  CasX variant 457
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacacaagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaacccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 210 - protein, 976 aa, Artificial Sequence
  CasX variant 457
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 211 - DNA, 2928 bp, Artificial Sequence
  CasX variant 438
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 212 - protein, 976 aa, Artificial Sequence
  CasX variant 438
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 213 - DNA, 2931 bp, Artificial Sequence
  CasX variant 488
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 214 - protein, 977 aa, Artificial Sequence; identical to SEQ ID NO: 123
  CasX variant 488

SEQ ID NO: 215 - DNA, 2931 bp, Artificial Sequence
  CasX variant 491
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 216 - protein, 977 aa, Artificial Sequence; identical to SEQ ID NO: 126
  CasX variant 491

SEQ ID NO: 217 - protein, 987 aa, Artificial Sequence
  CasX variant 278
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 218 - protein, 986 aa, Artificial Sequence
  CasX variant 279
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 219 - protein, 996 aa, Artificial Sequence
  CasX variant 280
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 220 - protein, 1006 aa, Artificial Sequence
  CasX variant 285
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPHKKKHPDASVNFSEFSK

SEQ ID NO: 221 - protein, 1007 aa, Artificial Sequence
  CasX variant 286
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPQRPGPYDRPQRPGPYDRP

SEQ ID NO: 222 - protein, 1005 aa, Artificial Sequence
  CasX variant 287
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPLSPSLSPLLSPSLSPL

SEQ ID NO: 223 - protein, 1008 aa, Artificial Sequence
  CasX variant 288
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPRGKGGKGLGKGGAKRHRK

SEQ ID NO: 224 - protein, 1013 aa, Artificial Sequence
  CasX variant 290
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPSRRRKANPTKLSENAKKLAKEVEN

SEQ ID NO: 225 - protein, 998 aa, Artificial Sequence
  CasX variant 291
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 226 - protein, 997 aa, Artificial Sequence
  CasX variant 293
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRSFSKAF

SEQ ID NO: 227 - protein, 1008 aa, Artificial Sequence
  CasX variant 300
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRGINDRNFWRGENERKTR

SEQ ID NO: 228 - protein, 1007 aa, Artificial Sequence
  CasX variant 492
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 229 - protein, 1009 aa, Artificial Sequence
  CasX variant 493
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 230 - DNA, 21 bp, Betapolyomavirus macaca mulatta polyomavirus 1
ccaaagaagaagcggaaggtc

SEQ ID NO: 231 - DNA, 51 bp, Unknown
  nuclear localization signal
cacaagaagaaacatccagacgcatcagtcaactttagcgagttcagtaaa

SEQ ID NO: 232 - DNA, 54 bp, Unknown
  nuclear localization signal
cagcgccctgggccttacgataggccgcaaagacccggaccgtatgatcgccct

SEQ ID NO: 233 - DNA, 48 bp, Unknown
  nuclear localization signal
ctcagcccgagtcttagtccactgctttccccgtccctgtctccactg

SEQ ID NO: 234 - DNA, 54 bp, Unknown
  nuclear localization signal
cggggcaagggtggcaaggggcttggcaaggggggggcaaagaggcacaggaag

SEQ ID NO: 235 - DNA, 72 bp, Caenorhabditis elegans
agccgccgcagaaaagccaatcctacaaaactgtcagaaaatgcgaaaaaacttgctaaggaggtggaaaac

SEQ ID NO: 236 - DNA, 27 bp, Homo sapiens
cctgccgcaaagcgagtgaaattggac

SEQ ID NO: 237 - DNA, 24 bp, Unknown
  nuclear localization signal
aagcggtccttcagtaaggccttt

SEQ ID NO: 238 - DNA, 57 bp, Alphainfluenzavirus influenza A virus
aaacggggaataaacgaccggaacttctggcgcggggaaaacgagcgcaaaacccga

SEQ ID NO: 239 - DNA, 2991 bp, Artificial Sequence
  CasX variant 387
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 240 - protein, 997 aa, Artificial Sequence
  CasX variant 387
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 241 - DNA, 2988 bp, Artificial Sequence
  CasX variant 395
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 242 - protein, 1005 aa, Artificial Sequence
  CasX variant 395
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVTSPKKKRKV

SEQ ID NO: 243 - DNA, 2988 bp, Artificial Sequence
  CasX variant 485
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 244 - protein, 996 aa, Artificial Sequence
  CasX variant 485
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 245 - DNA, 2988 bp, Artificial Sequence
  CasX variant 486
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 246 - protein, 996 aa, Artificial Sequence
  CasX variant 486
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 247 - DNA, 2988 bp, Artificial Sequence
  CasX variant 487
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 248 - protein, 996 aa, Artificial Sequence
  CasX variant 487
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 249 - DNA, 2991 bp, Artificial Sequence
  CasX variant 488
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 250 - protein, 997 aa, Artificial Sequence
  CasX variant 488
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 251 - DNA, 2991 bp, Artificial Sequence
  CasX variant 489
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 252 - protein, 997 aa, Artificial Sequence
  CasX variant 489
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 253 - DNA, 2991 bp, Artificial Sequence
  CasX variant 490
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 254 - protein, 997 aa, Artificial Sequence
  CasX variant 490
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 255 - DNA, 2991 bp, Artificial Sequence
  CasX variant 491
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 256 - protein, 997 aa, Artificial Sequence
  CasX variant 491
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 257 - DNA, 2991 bp, Artificial Sequence
  CasX variant 494
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 258 - protein, 997 aa, Artificial Sequence
  CasX variant 494
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 259 - DNA, 22 bp, Artificial Sequence
  T7 promoter primer
gaaattaatacgactcactata

SEQ ID NO: 260 - DNA, 87 bp, Artificial Sequence
  sg2 backbone fwd primer
gaaattaatacgactcactataggtactggcgcttttatctcattactttgagagccatcaccagcgactatgtcgtatgggtaaag

SEQ ID NO: 261 - DNA, 78 bp, Artificial Sequence
  sg2 backbone rev primer
ctttgatgcttcttatttatcggatttctctccgataaataagcgctttacccatacgacatagtcgctggtgatggc

SEQ ID NO: 262 - DNA, 54 bp, Artificial Sequence
  sg2.7.37 spacer primer
cggagcgagacatctcggccctttgatgcttcttatttatcggatttctctccg

SEQ ID NO: 263 - DNA, 90 bp, Artificial Sequence
  sg32 backbone fwd primer
gaaattaatacgactcactataggtactggcgcttttatctcattactttgagagccatcaccagcgactatgtcgtatgggtaaagcgc

SEQ ID NO: 264 - DNA, 46 bp, Artificial Sequence
  sg32 backbone rev primer
ctttgatgcttccctccgaagagggcgctttacccatacgacatag

SEQ ID NO: 265 - DNA, 43 bp, Artificial Sequence
  sg32.7.37 spacer primer
cggagcgagacatctcggccctttgatgcttccctccgaagag

SEQ ID NO: 266 - DNA, 90 bp, Artificial Sequence
  sg64 backbone fwd primer
gaaattaatacgactcactataggtactggcgcctttatctcattactttgagagccatcaccagcgactatgtcgtatgggtaaagcgc

SEQ ID NO: 267 - DNA, 54 bp, Artificial Sequence
  sg64 backbone rev primer
ctttgatgcttcttacggaccgaagtccgtaagcgctttacccatacgacatag

SEQ ID NO: 268 - DNA, 45 bp, Artificial Sequence
  sg64.7.37 spacer primer
cggagcgagacatctcggccctttgatgcttcttacggaccgaag

SEQ ID NO: 269 - DNA, 87 bp, Artificial Sequence
  sg174 backbone fwd primer
gaaattaatacgactcactataactggcgcttttatctgattactttgagagccatcaccagcgactatgtcgtagtgggtaaagct

SEQ ID NO: 270 - DNA, 50 bp, Artificial Sequence
  sg174 backbone rev primer
ctttgatgctccctccgaagagggagctttacccactacgacatagtcgc

SEQ ID NO: 271 - DNA, 36 bp, Artificial Sequence
  sg174.7.37 spacer primer
cggagcgagacatctcggccctttgatgctccctcc

SEQ ID NO: 272 - RNA, 130 nt, Artificial Sequence
  guide RNA
gguacuggcgcuuuuaucucauuacuuugagagccaucaccagcgacuaugucguauggguaaagcgcuuauuuaucggagagaaauccgauaaauaagaagcaucaaagggccgagaugucucgcuccg

SEQ ID NO: 273 - RNA, 107 nt, Artificial Sequence
  guide RNA
gguacuggcgcuuuuaucucauuacuuugagagccaucaccagcgacuaugucguauggguaaagcgcccucuucggagggaagcaucaaagggccgagaugucucg

SEQ ID NO: 274 - RNA, 120 nt, Artificial Sequence
  guide RNA
gguacuggcgccuuuaucucauuacuuugagagccaucaccagcgacuaugucguauggguaaagcgcuuacggacuucgguccguaagaagcaucaaagggccgagaugucucgcuccg

SEQ ID NO: 275 - RNA, 109 nt, Artificial Sequence
  guide RNA
acuggcgcuuuuaucugauuacuuugagagccaucaccagcgacuaugucguaguggguaaagcucccucuucggagggagcaucaaagggccgagaugucucgcuccg

SEQ ID NO: 276 - DNA, 20 bp, Artificial Sequence
  spacer sequence
gaggaggacggcctggccga

SEQ ID NO: 277 - DNA, 20 bp, Artificial Sequence
  spacer sequence
accgctgcgccaaggtgcgg

SEQ ID NO: 278 - DNA, 20 bp, Artificial Sequence
  spacer sequence
gccaggccgtcctcctcgga

SEQ ID NO: 279 - DNA, 20 bp, Artificial Sequence
  spacer sequence
gtgctcgggtgcttcggcca

SEQ ID NO: 280 - DNA, 20 bp, Artificial Sequence
  spacer sequence
atggccttcttcctggcttc

SEQ ID NO: 281 - DNA, 20 bp, Artificial Sequence
  spacer sequence
gcaccaccacgtaggtgcca

SEQ ID NO: 282 - DNA, 20 bp, Artificial Sequence
  spacer sequence
tcctggcttcctggtgaaga

SEQ ID NO: 283 - DNA, 20 bp, Artificial Sequence
  spacer sequence
tggcttcctggtgaagatga

SEQ ID NO: 284 - DNA, 20 bp, Artificial Sequence
  spacer sequence
ccaggaagccaggaagaagg

SEQ ID NO: 285 - DNA, 20 bp, Artificial Sequence
  spacer sequence
tccttgcatggggccaggat

SEQ ID NO: 286 - DNA, 20 bp, Artificial Sequence
  spacer sequence
ggcggcaagttctgctcagc

SEQ ID NO: 287 - DNA, 20 bp, Artificial Sequence
  spacer sequence
tctccacgatcgtcagcgtg

SEQ ID NO: 288 - DNA, 20 bp, Artificial Sequence
  spacer sequence
acgatcgtcagcgtgagtgc

SEQ ID NO: 289 - DNA, 20 bp, Artificial Sequence
  spacer sequence
ctctagcaatggatcgtggg

SEQ ID NO: 290 - DNA, 20 bp, Artificial Sequence
  spacer sequence
caaacaaatgtgtcacaaag

SEQ ID NO: 291 - DNA, 20 bp, Artificial Sequence
  spacer sequence
gatgtgtatatcacagacaa

SEQ ID NO: 292 - DNA, 20 bp, Artificial Sequence
  spacer sequence
ggaataatgctgttgttgaa

SEQ ID NO: 293 - DNA, 20 bp, Artificial Sequence
  spacer sequence
aaatccagtgacaagtctgt

SEQ ID NO: 294 - DNA, 20 bp, Artificial Sequence
  spacer sequence
aggccacagcactgttgctc

SEQ ID NO: 295 - DNA, 20 bp, Artificial Sequence
  spacer sequence
agaagacaccttcttcccca

SEQ ID NO: 296 - DNA, 20 bp, Artificial Sequence
  spacer sequence
tccccagcccaggtaagggc

SEQ ID NO: 297 - DNA, 20 bp, Artificial Sequence
  spacer sequence
ccagcccaggtaagggcagc

SEQ ID NO: 298 - DNA, 20 bp, Artificial Sequence
  spacer sequence
agtccctcaagtccttccag

SEQ ID NO: 299 - DNA, 20 bp, Artificial Sequence
  spacer sequence
agcagcagcagcagcagcag

SEQ ID NO: 300 - DNA, 20 bp, Artificial Sequence
  spacer sequence
tcagccgccgccgcaggcac

SEQ ID NO: 301 - DNA, 20 bp, Artificial Sequence
  spacer sequence
agggtcgccatggcggtctc

SEQ ID NO: 302 - DNA, 20 bp, Artificial Sequence
  spacer sequence
tcagcttttccagggtcgcc

SEQ ID NO: 303 - DNA, 20 bp, Artificial Sequence
  spacer sequence
gccgcagccgcccccgccgc

SEQ ID NO: 304 - DNA, 20 bp, Artificial Sequence
  spacer sequence
gccacagccgggccgggtgg

SEQ ID NO: 305 - DNA, 20 bp, Artificial Sequence
  spacer sequence
tcagccacagccgggccggg

SEQ ID NO: 306 - DNA, 20 bp, Artificial Sequence
  spacer sequence
cggtcggtgcagcggctcct

SEQ ID NO: 307 - DNA, 20 bp, Artificial Sequence
  spacer sequence
ccacaccttcactggtccat

SEQ ID NO: 308 - DNA, 20 bp, Artificial Sequence
  spacer sequence
taaaggaaagtaatggacca

SEQ ID NO: 309 - DNA, 20 bp, Artificial Sequence
  spacer sequence
ctggtccattactttccttt

SEQ ID NO: 310 - DNA, 20 bp, Artificial Sequence
  spacer sequence
atgttcatgagtttggagat

SEQ ID NO: 311 - DNA, 20 bp, Artificial Sequence
  spacer sequence
tgagtttggagataatacag

SEQ ID NO: 312 - DNA, 20 bp, Artificial Sequence
  spacer sequence
atagacacatcggccacacc

SEQ ID NO: 313 - DNA, 20 bp, Artificial Sequence
  spacer sequence
ttattaggcatgttggagac

SEQ ID NO: 314 - DNA, 20 bp, Artificial Sequence
  spacer sequence
caggagaccattgcatcatt

SEQ ID NO: 315 - DNA, 20 bp, Artificial Sequence
  spacer sequence
ggcctggaggctatccagcg

SEQ ID NO: 316 - DNA, 20 bp, Artificial Sequence
  spacer sequence
ggccgagatgtctcgctccg

SEQ ID NO: 317 - DNA, 20 bp, Artificial Sequence
  spacer sequence
aggccagaaagagagagtag

SEQ ID NO: 318 - DNA, 20 bp, Artificial Sequence
  spacer sequence
cgctggatagcctccaggcc

SEQ ID NO: 319 - DNA, 20 bp, Artificial Sequence
  spacer sequence
tgaagctgacagcattcggg

SEQ ID NO: 320 - RNA, 20 nt, Artificial Sequence
  spacer sequence
gaggaggacggccuggccga

SEQ ID NO: 321 - RNA, 20 nt, Artificial Sequence
  spacer sequence
accgcugcgccaaggugcgg

SEQ ID NO: 322 - RNA, 20 nt, Artificial Sequence
  spacer sequence
gccaggccguccuccucgga

SEQ ID NO: 323 - RNA, 20 nt, Artificial Sequence
  spacer sequence
gugcucgggugcuucggcca

SEQ ID NO: 324 - RNA, 20 nt, Artificial Sequence
  spacer sequence
auggccuucuuccuggcuuc

SEQ ID NO: 325 - RNA, 20 nt, Artificial Sequence
  spacer sequence
gcaccaccacguaggugcca

SEQ ID NO: 326 - RNA, 20 nt, Artificial Sequence
  spacer sequence
uccuggcuuccuggugaaga

SEQ ID NO: 327 - RNA, 20 nt, Artificial Sequence
  spacer sequence
uggcuuccuggugaagauga

SEQ ID NO: 328 - RNA, 20 nt, Artificial Sequence
  spacer sequence
ccaggaagccaggaagaagg

SEQ ID NO: 329 - RNA, 20 nt, Artificial Sequence
  spacer sequence
uccuugcauggggccaggau

SEQ ID NO: 330 - RNA, 20 nt, Artificial Sequence
  spacer sequence
ggcggcaaguucugcucagc

SEQ ID NO: 331 - RNA, 20 nt, Artificial Sequence
  spacer sequence
ucuccacgaucgucagcgug

SEQ ID NO: 332 - RNA, 20 nt, Artificial Sequence
  spacer sequence
acgaucgucagcgugagugc

SEQ ID NO: 333 - RNA, 20 nt, Artificial Sequence
  spacer sequence
cucuagcaauggaucguggg

SEQ ID NO: 334 - RNA, 20 nt, Artificial Sequence
  spacer sequence
caaacaaaugugucacaaag

SEQ ID NO: 335 - RNA, 20 nt, Artificial Sequence
  spacer sequence
gauguguauaucacagacaa

SEQ ID NO: 336 - RNA, 20 nt, Artificial Sequence
  spacer sequence
ggaauaaugcuguuguugaa

SEQ ID NO: 337 - RNA, 20 nt, Artificial Sequence
  spacer sequence
aaauccagugacaagucugu

SEQ ID NO: 338 - RNA, 20 nt, Artificial Sequence
  spacer sequence
aggccacagcacuguugcuc

SEQ ID NO: 339 - RNA, 20 nt, Artificial Sequence
  spacer sequence
agaagacaccuucuucccca

SEQ ID NO: 340 - RNA, 20 nt, Artificial Sequence
  spacer sequence
uccccagcccagguaagggc

SEQ ID NO: 341 - RNA, 20 nt, Artificial Sequence
  spacer sequence
ccagcccagguaagggcagc

SEQ ID NO: 342 - RNA, 20 nt, Artificial Sequence
  spacer sequence
agucccucaaguccuuccag

SEQ ID NO: 343 - RNA, 20 nt, Artificial Sequence
  spacer sequence
agcagcagcagcagcagcag

SEQ ID NO: 344 - RNA, 20 nt, Artificial Sequence
  spacer sequence
ucagccgccgccgcaggcac

SEQ ID NO: 345 - RNA, 20 nt, Artificial Sequence
  spacer sequence
agggucgccauggcggucuc

SEQ ID NO: 346 - RNA, 20 nt, Artificial Sequence
  spacer sequence
ucagcuuuuccagggucgcc

SEQ ID NO: 347 - RNA, 20 nt, Artificial Sequence
  spacer sequence
gccgcagccgcccccgccgc

SEQ ID NO: 348 - RNA, 20 nt, Artificial Sequence
  spacer sequence
gccacagccgggccgggugg

SEQ ID NO: 349 - RNA, 20 nt, Artificial Sequence
  spacer sequence
ucagccacagccgggccggg

SEQ ID NO: 350 - RNA, 20 nt, Artificial Sequence
  spacer sequence
cggucggugcagcggcuccu

SEQ ID NO: 351 - RNA, 20 nt, Artificial Sequence
  spacer sequence
ccacaccuucacugguccau

SEQ ID NO: 352 - RNA, 20 nt, Artificial Sequence
  spacer sequence
uaaaggaaaguaauggacca

SEQ ID NO: 353 - RNA, 20 nt, Artificial Sequence
  spacer sequence
cugguccauuacuuuccuuu

SEQ ID NO: 354 - RNA, 20 nt, Artificial Sequence
  spacer sequence
auguucaugaguuuggagau

SEQ ID NO: 355 - RNA, 20 nt, Artificial Sequence
  spacer sequence
ugaguuuggagauaauacag

SEQ ID NO: 356 - RNA, 20 nt, Artificial Sequence
  spacer sequence
auagacacaucggccacacc

SEQ ID NO: 357 - RNA, 20 nt, Artificial Sequence
  spacer sequence
uuauuaggcauguuggagac

SEQ ID NO: 358 - RNA, 20 nt, Artificial Sequence
  spacer sequence
caggagaccauugcaucauu

SEQ ID NO: 359 - RNA, 20 nt, Artificial Sequence
  spacer sequence
ggccuggaggcuauccagcg

SEQ ID NO: 360 - RNA, 20 nt, Artificial Sequence
  spacer sequence
ggccgagaugucucgcuccg

SEQ ID NO: 361 - RNA, 20 nt, Artificial Sequence
  spacer sequence
aggccagaaagagagaguag

SEQ ID NO: 362 - RNA, 20 nt, Artificial Sequence
  spacer sequence
cgcuggauagccuccaggcc

SEQ ID NO: 363 - RNA, 20 nt, Artificial Sequence
  spacer sequence
ugaagcugacagcauucggg

SEQ ID NO: 364 - DNA, 60 bp, Artificial Sequence
  beta-2 microglobulin (B2M) 7.37 oligonucleotide
tgaagctgacagcattcgggccgagatgtctcgctccgtggccttagctgtgctcgcgct

SEQ ID NO: 365 - DNA, 60 bp, Artificial Sequence; identical to SEQ ID NO: 364
  beta-2 microglobulin (B2M) 7.37 oligonucleotide

SEQ ID NO: 366 - DNA, 20 bp, Artificial Sequence
  spacer sequence
tcgccataactcgctaggcc

SEQ ID NO: 367 - DNA, 4667 bp, Artificial Sequence
  plasmid pStX17
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggcctctagactcgaggcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactaccggtgccaccatggccccaaagaagaagcggaaggtcagccaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgctgccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccgccaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagattacaaagatgacgatgacaaagactacaaggatgatgatgataagggatcctacccatacgatgttccagattacgcttacccatacgatgttccagattacgcttacccatacgatgttccagattacgcttaagaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggaggtaccgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtactggcgcttttatctcattactttgagagccatcaccagcgactatgtcgtatgggtaaagcgcttatttatcggagagaaatccgataaataagaagcatcaaaggggtcttcgagaagacccttttttttggcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 368 - DNA, 20 bp, Artificial Sequence
  spacer sequence
gcacgcacacggccttcgtc

SEQ ID NO: 369 - DNA, 20 bp, Artificial Sequence
  spacer sequence
gcacgcacacgaccttcgtc

SEQ ID NO: 370 - RNA, 20 nt, Artificial Sequence
  spacer sequence
gcacgcacacggccuucguc

SEQ ID NO: 371 - RNA, 20 nt, Artificial Sequence
  spacer sequence
gcacgcacacgaccuucguc

SEQ ID NO: 372 - RNA, 20 nt, Artificial Sequence
  spacer sequence
aucagggauuuaaacucagg

SEQ ID NO: 373 - RNA, 20 nt, Artificial Sequence
  spacer sequence
uuugcccccacccccaaacg

SEQ ID NO: 374 - RNA, 20 nt, Artificial Sequence
  spacer sequence
auaaagauauuuagcuggaa

SEQ ID NO: 375 - RNA, 20 nt, Artificial Sequence
  spacer sequence
uuauugacaguguuuaagcu

SEQ ID NO: 376 - RNA, 20 nt, Artificial Sequence
  spacer sequence
agcuaaauaucuuuauugac

SEQ ID NO: 377 - RNA, 20 nt, Artificial Sequence
  spacer sequence
acuguuaggauauaauuuua

SEQ ID NO: 378 - RNA, 20 nt, Artificial Sequence
  spacer sequence
uaacaguugaguuccagcua

SEQ ID NO: 379 - RNA, 20 nt, Artificial Sequence
  spacer sequence
gucauuuuacuguuauaaga

SEQ ID NO: 380 - RNA, 20 nt, Artificial Sequence
  spacer sequence
uuuuacuguuauaagauuuu

SEQ ID NO: 381 - RNA, 20 nt, Artificial Sequence
  spacer sequence
uauaacaguaaaaugacuga

SEQ ID NO: 382 - RNA, 20 nt, Artificial Sequence
  spacer sequence
uaaaaucuuauaacaguaaa

SEQ ID NO: 383 - RNA, 20 nt, Artificial Sequence
  spacer sequence
auauaaauacccauaauaac

SEQ ID NO: 384 - RNA, 20 nt, Artificial Sequence
  spacer sequence
gcauaaacacucaccccucc

SEQ ID NO: 385 - RNA, 20 nt, Artificial Sequence
  spacer sequence
ccccuccaacaaagcuaaaa

SEQ ID NO: 386 - RNA, 20 nt, Artificial Sequence
  spacer sequence
aacaaagcuaaaaaacaaag

SEQ ID NO: 387 - RNA, 20 nt, Artificial Sequence
  spacer sequence
ugcuuuguuuuuuagcuuug

SEQ ID NO: 388 - RNA, 20 nt, Artificial Sequence
  spacer sequence
uucuugcuuuguuuuuuagc

SEQ ID NO: 389 - RNA, 20 nt, Artificial Sequence
  spacer sequence
uucuuucuugcuuuguuuuu

SEQ ID NO: 390 - RNA, 20 nt, Artificial Sequence
  spacer sequence
cuuucuuucuugcuuuguuu

SEQ ID NO: 391 - RNA, 20 nt, Artificial Sequence
  spacer sequence
cucuuucuuucuugcuuugu

SEQ ID NO: 392 - RNA, 20 nt, Artificial Sequence
  spacer sequence
cucucucuuucuuucuugcu

SEQ ID NO: 393 - RNA, 20 nt, Artificial Sequence
  spacer sequence
cgcucucucuuucuuucuug

SEQ ID NO: 394 - RNA, 20 nt, Artificial Sequence
  spacer sequence
cucgcucucucuuucuuucu

SEQ ID NO: 395 - RNA, 20 nt, Artificial Sequence
  spacer sequence
uucucucgcucucucuuucu

SEQ ID NO: 396 - RNA, 20 nt, Artificial Sequence
  spacer sequence
cuuucucucgcucucucuuu

SEQ ID NO: 397 - RNA, 20 nt, Artificial Sequence
  spacer sequence
cucuuucucucgcucucucu

SEQ ID NO: 398 - RNA, 20 nt, Artificial Sequence
  spacer sequence
cucucuuucucucgcucucu

SEQ ID NO: 399 - RNA, 20 nt, Artificial Sequence
  spacer sequence
cucucucuuucucucgcucu

SEQ ID NO: 400 - RNA, 20 nt, Artificial Sequence
  spacer sequence
cucucucucuuucucucgcu

SEQ ID NO: 401 - RNA, 20 nt, Artificial Sequence
  spacer sequence
cucucucucucuuucucucg

SEQ ID NO: 402 - RNA, 20 nt, Artificial Sequence
  spacer sequence
cucucucucucucuuucucu

SEQ ID NO: 403 - RNA, 20 nt, Artificial Sequence
  spacer sequence
cucucucucucucucuuucu

SEQ ID NO: 404 - RNA, 20 nt, Artificial Sequence
  spacer sequence
cucucucucucucucucuuu

SEQ ID NO: 405 - RNA, 20 nt, Artificial Sequence
  spacer sequence
uuucucucucucucucucuc

SEQ ID NO: 406 - RNA, 20 nt, Artificial Sequence
  spacer sequence
uuucuuuucucucucucucu

SEQ ID NO: 407 - RNA, 20 nt, Artificial Sequence
  spacer sequence
uucuuuucuuuucucucucu

SEQ ID NO: 408 - RNA, 20 nt, Artificial Sequence
  spacer sequence
uucuuucuuuucuuuucucu

SEQ ID NO: 409 - RNA, 20 nt, Artificial Sequence
  spacer sequence
uuucuuucuuucuuuucuuu

SEQ ID NO: 410 - RNA, 20 nt, Artificial Sequence
  spacer sequence
aauuguaacauuccuuucuu

SEQ ID NO: 411 - RNA, 20 nt, Artificial Sequence
  spacer sequence
accaaguucaaauuguaaca

SEQ ID NO: 412 - RNA, 20 nt, Artificial Sequence
  spacer sequence
uuuuuaaucaaaugucacaa

SEQ ID NO: 413 - RNA, 20 nt, Artificial Sequence
  spacer sequence
aaugucacaaaaucucaguu

SEQ ID NO: 414 - RNA, 20 nt, Artificial Sequence
  spacer sequence
caaaaucucaguuuuuguuu

SEQ ID NO: 415 - RNA, 20 nt, Artificial Sequence
  spacer sequence
caguuuuuguuuccuauaaa

SEQ ID NO: 416 - RNA, 20 nt, Artificial Sequence
  spacer sequence
guuuuuguuuccuauaaaga

SEQ ID NO: 417 - RNA, 20 nt, Artificial Sequence
  spacer sequence
uauaaagagaaauuuaaaau

SEQ ID NO: 418 - RNA, 20 nt, Artificial Sequence
  spacer sequence
uuauaggaaacaaaaacuga

SEQ ID NO: 419 - RNA, 20 nt, Artificial Sequence
  spacer sequence
cuuuauaggaaacaaaaacu

SEQ ID NO: 420 - RNA, 20 nt, Artificial Sequence
  spacer sequence
auuaaaacuguagauuuaaa

SEQ ID NO: 421 - RNA, 20 nt, Artificial Sequence
  spacer sequence
acaguuuuaauggaauuuua

SEQ ID NO: 422 - RNA, 20 nt, Artificial Sequence
  spacer sequence
uuuuagucaaaugucacaaa

SEQ ID NO: 423 - RNA, 20 nt, Artificial Sequence
  spacer sequence
aaugucacaaaaucucaguc

SEQ ID NO: 424 - RNA, 20 nt, Artificial Sequence
  spacer sequence
caaaaucucagucuuuguuu

SEQ ID NO: 425 - RNA, 20 nt, Artificial Sequence
  spacer sequence
cagucuuuguuuccuauaga

SEQ ID NO: 426 - RNA, 20 nt, Artificial Sequence
  spacer sequence
gucuuuguuuccuauagaaa

SEQ ID NO: 427 - RNA, 20 nt, Artificial Sequence
  spacer sequence
uuguuuccuauagaaauuua

SEQ ID NO: 428 - RNA, 20 nt, Artificial Sequence
  spacer sequence
uauagaaauuuaaaaaucca

SEQ ID NO: 429 - RNA, 20 nt, Artificial Sequence
  spacer sequence
auaggaaacaaagacugaga

SEQ ID NO: 430 - RNA, 20 nt, Artificial Sequence
  spacer sequence
auaaaaacuuacuaauccug

SEQ ID NO: 431 - RNA, 20 nt, Artificial Sequence
  spacer sequence
uguuagcuuguugugaaagu

SEQ ID NO: 432 - RNA, 20 nt, Artificial Sequence
  spacer sequence
caacaagcuaacaggauuag

SEQ ID NO: 433 - RNA, 20 nt, Artificial Sequence
  spacer sequence
aauauacauuaacaaucuuu

SEQ ID NO: 434 - RNA, 20 nt, Artificial Sequence
  spacer sequence
uuaaaaauaucaaaauagag

SEQ ID NO: 435 - RNA, 20 nt, Artificial Sequence
  spacer sequence
aaauagagcaucucagucuc

SEQ ID NO: 436 - RNA, 20 nt, Artificial Sequence
  spacer sequence
auuuugauauuuuuaaagau

SEQ ID NO: 437 - RNA, 20 nt, Artificial Sequence
  spacer sequence
cagucuccgaaacauguuuu

SEQ ID NO: 438 - RNA, 20 nt, Artificial Sequence
  spacer sequence
gucuccgaaacauguuuuuu

SEQ ID NO: 439 - RNA, 20 nt, Artificial Sequence
  spacer sequence
ccgaaacauguuuuuucaca

SEQ ID NO: 440 - RNA, 20 nt, Artificial Sequence
  spacer sequence
gaaacauguuuuuucacacg

SEQ ID NO: 441 - RNA, 20 nt, Artificial Sequence
  spacer sequence
gagacugagaugcucuauuu

SEQ ID NO: 442 - RNA, 20 nt, Artificial Sequence
  spacer sequence
cacgcaggauuugacggugu

SEQ ID NO: 443 - RNA, 20 nt, Artificial Sequence
  spacer sequence
ugcgugugaaaaaacauguu

SEQ ID NO: 444 - RNA, 20 nt, Artificial Sequence
  spacer sequence
aauccugcgugugaaaaaac

SEQ ID NO: 445 - RNA, 20 nt, Artificial Sequence
  spacer sequence
ucagucaaaucucacuggaa

SEQ ID NO: 446 - RNA, 20 nt, Artificial Sequence
  spacer sequence
gucaaaucucacuggaaguu

SEQ ID NO: 447 - RNA, 20 nt, Artificial Sequence
  spacer sequence
aaucucacuggaaguuaccc

SEQ ID NO: 448 - RNA, 20 nt, Artificial Sequence
  spacer sequence
cacuggaaguuaccccgccc

SEQ ID NO: 449 - RNA, 20 nt, Artificial Sequence
  spacer sequence
cuggaaguuaccccgccccc

SEQ ID NO: 450 - RNA, 20 nt, Artificial Sequence
  spacer sequence
agugagauuugacugaugac

SEQ ID NO: 451 - RNA, 20 nt, Artificial Sequence
  spacer sequence
cacagcacauggccugccug

SEQ ID NO: 452 - RNA, 20 nt, Artificial Sequence
  spacer sequence
ugucacacagcacauggccu

SEQ ID NO: 453 - RNA, 20 nt, Artificial Sequence
  spacer sequence
gccugcugugcuucuuguca

SEQ ID NO: 454 - RNA, 20 nt, Artificial Sequence
  spacer sequence
uaaacugucggccugcugug

SEQ ID NO: 455 - RNA, 20 nt, Artificial Sequence
  spacer sequence
ccaaauguuaucgacaaaca

SEQ ID NO: 456 - RNA, 20 nt, Artificial Sequence
  spacer sequence
aaauguuaucgacaaacaaa

SEQ ID NO: 457 - RNA, 20 nt, Artificial Sequence
  spacer sequence
acaaacaaacagaggaccau

SEQ ID NO: 458 - RNA, 20 nt, Artificial Sequence
  spacer sequence
auaacauuuggagacacgcg

SEQ ID NO: 459 - RNA, 20 nt, Artificial Sequence
  spacer sequence
guuuguuugucgauaacauu

SEQ ID NO: 460 - RNA, 20 nt, Artificial Sequence
  spacer sequence
ucuguuuguuugucgauaac

SEQ ID NO: 461 - RNA, 20 nt, Artificial Sequence
  spacer sequence
gugagacuucagagaaucug

SEQ ID NO: 462 - RNA, 20 nt, Artificial Sequence
  spacer sequence
cagauacccggcagcacaug

SEQ ID NO: 463 - RNA, 20 nt, Artificial Sequence
  spacer sequence
cacagauacccggcagcaca

SEQ ID NO: 464 - RNA, 20 nt, Artificial Sequence
  spacer sequence
gagaaucugaagcccuggac

SEQ ID NO: 465 - RNA, 20 nt, Artificial Sequence
  spacer sequence
gaagucucacagauacccgg

SEQ ID NO: 466 - RNA, 20 nt, Artificial Sequence
  spacer sequence
cugaagucucacagauaccc

SEQ ID NO: 467 - RNA, 20 nt, Artificial Sequence
  spacer sequence
gaagcccuggaccauauuug

SEQ ID NO: 468 - RNA, 20 nt, Artificial Sequence
  spacer sequence
gauucucugaagucucacag

SEQ ID NO: 469 - RNA, 20 nt, Artificial Sequence
  spacer sequence
agggcuucagauucucugaa

SEQ ID NO: 470 - RNA, 20 nt, Artificial Sequence
  spacer sequence
cacaaacaaauaugguccag

SEQ ID NO: 471 - RNA, 20 nt, Artificial Sequence
  spacer sequence
ucccacaaacaaauaugguc

SEQ ID NO: 472 - RNA, 20 nt, Artificial Sequence
  spacer sequence
cuucccacaaacaaauaugg

SEQ ID NO: 473 - RNA, 20 nt, Artificial Sequence
  spacer sequence
gugcaguuccucuuccuuug

SEQ ID NO: 474 - RNA, 20 nt, Artificial Sequence
  spacer sequence
ucuuccuuugccgccccucc

SEQ ID NO: 475 - RNA, 20 nt, Artificial Sequence
  spacer sequence
uccuuugccgccccucccug

SEQ ID NO: 476 - RNA, 20 nt, Artificial Sequence
  spacer sequence
uuugccgccccucccugccg

SEQ ID NO: 477 - RNA, 20 nt, Artificial Sequence
  spacer sequence
cugccgccugacugucuucg

SEQ ID NO: 478 - RNA, 20 nt, Artificial Sequence
  spacer sequence
ggcggcagggaggggcggca

SEQ ID NO: 479 - RNA, 20 nt, Artificial Sequence
  spacer sequence
ucgguuuucagaaucgagcu

SEQ ID NO: 480 - RNA, 20 nt, Artificial Sequence
  spacer sequence
guuuucagaaucgagcucca

SEQ ID NO: 481 - RNA, 20 nt, Artificial Sequence
  spacer sequence
gaaucgagcuccaggccauc

SEQ ID NO: 482 - RNA, 20 nt, Artificial Sequence
  spacer sequence
gaaaaccgaagacagucagg

SEQ ID NO: 483 - RNA, 20 nt, Artificial Sequence
  spacer sequence
agcuccaggccaucuccaug

SEQ ID NO: 484 - RNA, 20 nt, Artificial Sequence
  spacer sequence
auucugaaaaccgaagacag

SEQ ID NO: 485 - RNA, 20 nt, Artificial Sequence
  spacer sequence
aggccaucuccauggaacau

SEQ ID NO: 486 - RNA, 20 nt, Artificial Sequence
  spacer sequence
ccauggaacaucagaccaaa

SEQ ID NO: 487 - RNA, 20 nt, Artificial Sequence
  spacer sequence
auggaacaucagaccaaaau

SEQ ID NO: 488 - RNA, 20 nt, Artificial Sequence
  spacer sequence
auggagauggccuggagcuc

SEQ ID NO: 489 - RNA, 20 nt, Artificial Sequence
  spacer sequence
gaccaaaauagaaccucaca

SEQ ID NO: 490 - RNA, 20 nt, Artificial Sequence
  spacer sequence
gauguuccauggagauggcc

SEQ ID NO: 491 - RNA, 20 nt, Artificial Sequence
  spacer sequence
auuuuggucugauguuccau

SEQ ID NO: 492 - RNA, 20 nt, Artificial Sequence
  spacer sequence
cacuucacggguacugcaca

SEQ ID NO: 493 - RNA, 20 nt, Artificial Sequence
  spacer sequence
cggguacugcacagaggcac

SEQ ID NO: 494 - RNA, 20 nt, Artificial Sequence
  spacer sequence
gugcaguacccgugaagugu

SEQ ID NO: 495 - RNA, 20 nt, Artificial Sequence
  spacer sequence
ugcccaugcagaccaagcgg

SEQ ID NO: 496 - RNA, 20 nt, Artificial Sequence
  spacer sequence
gcaugggcaggacgugccuc

SEQ ID NO: 497 - RNA, 20 nt, Artificial Sequence
  spacer sequence
gugcucagcacuuggcaauu

SEQ ID NO: 498 - RNA, 20 nt, Artificial Sequence
  spacer sequence
gcacuuggcaauuccucucu

SEQ ID NO: 499 - RNA, 20 nt, Artificial Sequence
  spacer sequence
ucucucugaagcaaggugcc

SEQ ID NO: 500 - RNA, 20 nt, Artificial Sequence
  spacer sequence
cucugaagcaaggugccuuc

SEQ ID NO: 501 - RNA, 20 nt, Artificial Sequence
  spacer sequence
cugaagcaaggugccuucga

SEQ ID NO: 502 - RNA, 20 nt, Artificial Sequence
  spacer sequence
gaagcaaggugccuucgacu

SEQ ID NO: 503 - RNA, 20 nt, Artificial Sequence
  spacer sequence
gagagaggaauugccaagug

SEQ ID NO: 504 - RNA, 20 nt, Artificial Sequence
  spacer sequence
acuuucacggcuaucacaga

SEQ ID NO: 505 - RNA, 20 nt, Artificial Sequence
  spacer sequence
aaggcaccuugcuucagaga

SEQ ID NO: 506 - RNA, 20 nt, Artificial Sequence
  spacer sequence
cggcuaucacagaggccuuu

SEQ ID NO: 507 - RNA, 20 nt, Artificial Sequence
  spacer sequence
cagaggccuuuccuguucaa

SEQ ID NO: 508 - RNA, 20 nt, Artificial Sequence
  spacer sequence
gugauagccgugaaagucga

SEQ ID NO: 509 - RNA, 20 nt, Artificial Sequence
  spacer sequence
uguucaacaaacgcugcuua

SEQ ID NO: 510 - RNA, 20 nt, Artificial Sequence
  spacer sequence
acaaacgcugcuuaaucuac

SEQ ID NO: 511 - RNA, 20 nt, Artificial Sequence
  spacer sequence
acuuccugcaggagggacac

SEQ ID NO: 512 - RNA, 20 nt, Artificial Sequence
  spacer sequence
ugcaggagggacacuggucu

SEQ ID NO: 513 - RNA, 20 nt, Artificial Sequence
  spacer sequence
ugcaggaaguagauuaagca

SEQ ID NO: 514 - RNA, 20 nt, Artificial Sequence
  spacer sequence
cuccugcaggaaguagauua

SEQ ID NO: 515 - RNA, 20 nt, Artificial Sequence
  spacer sequence
ggacugcagagcacaagcuu

SEQ ID NO: 516 - RNA, 20 nt, Artificial Sequence
  spacer sequence
agaccagugucccuccugca

SEQ ID NO: 517 - RNA, 20 nt, Artificial Sequence
  spacer sequence
gcaguccagaccaguguccc

SEQ ID NO: 518 - RNA, 20 nt, Artificial Sequence
  spacer sequence
acuuggcaucagacagacac

SEQ ID NO: 519 - RNA, 20 nt, Artificial Sequence
  spacer sequence
gacagacacgccugagguuu

SEQ ID NO: 520 - RNA, 20 nt, Artificial Sequence
  spacer sequence
gaugccaaguggaagcuugu

SEQ ID NO: 521 - RNA, 20 nt, Artificial Sequence
  spacer sequence
gucugaugccaaguggaagc

SEQ ID NO: 522 - RNA, 20 nt, Artificial Sequence
  spacer sequence
ggcgugucugucugaugcca

SEQ ID NO: 523 - RNA, 20 nt, Artificial Sequence
  spacer sequence
aaggaucugacucugcaacu

SEQ ID NO: 524 - RNA, 20 nt, Artificial Sequence
  spacer sequence
uuugauaaaccucaggcgug

SEQ ID NO: 525 - RNA, 20 nt, Artificial Sequence
  spacer sequence
gacucugcaacuccagcgcu

SEQ ID NO: 526 - RNA, 20 nt, Artificial Sequence
  spacer sequence
gauccuuugauaaaccucag

SEQ ID NO: 527 - RNA, 20 nt, Artificial Sequence
  spacer sequence
gcaacuccagcgcuggcccu

SEQ ID NO: 528 - RNA, 20 nt, Artificial Sequence
  spacer sequence
agcgcuggcccuaauugccu

SEQ ID NO: 529 - RNA, 20 nt, Artificial Sequence
  spacer sequence
ccaacaccacagcaggaaua

SEQ ID NO: 530 - RNA, 20 nt, Artificial Sequence
  spacer sequence
aacaccacagcaggaauaac

SEQ ID NO: 531 - RNA, 20 nt, Artificial Sequence
  spacer sequence
ugcugugguguuggagaaag

SEQ ID NO: 532 - RNA, 20 nt, Artificial Sequence
  spacer sequence
aaaaaugguuauuccugcug

SEQ ID NO: 533 - RNA, 20 nt, Artificial Sequence
  spacer sequence
uguucaaaaaaugguuauuc

SEQ ID NO: 534 - RNA, 20 nt, Artificial Sequence
  spacer sequence
uggaacgcuggaacuuuuau

SEQ ID NO: 535 - RNA, 20 nt, Artificial Sequence
  spacer sequence
aagagcugcuucuuguucaa

SEQ ID NO: 536 - RNA, 20 nt, Artificial Sequence
  spacer sequence
agcguuccaagagcugcuuc

SEQ ID NO: 537 - RNA, 20 nt, Artificial Sequence
  spacer sequence
cuuuuucuuuuuuugagaga

SEQ ID NO: 538 - RNA, 20 nt, Artificial Sequence
  spacer sequence
uuuucuuuuuuugagagaga

SEQ ID NO: 539 - RNA, 20 nt, Artificial Sequence
  spacer sequence
uuuuuugagagagaguuucg

SEQ ID NO: 540 - RNA, 20 nt, Artificial Sequence
  spacer sequence
aaaaaagaaaaagagaaaaa

SEQ ID NO: 541 - RNA, 20 nt, Artificial Sequence
  spacer sequence
caaaaaaagaaaaagagaaa

SEQ ID NO: 542 - RNA, 20 nt, Artificial Sequence
  spacer sequence
cucaaaaaaagaaaaagaga

SEQ ID NO: 543 - RNA, 20 nt, Artificial Sequence
  spacer sequence
cucucaaaaaaagaaaaaga

SEQ ID NO: 544 - RNA, 20 nt, Artificial Sequence
  spacer sequence
cucuuguuguccaggcuaga

SEQ ID NO: 545 - RNA, 20 nt, Artificial Sequence
  spacer sequence
uguuguccaggcuagagcgc

SEQ ID NO: 546 - RNA, 20 nt, Artificial Sequence
  spacer sequence
aggcuagagcgcaguggugc

SEQ ID NO: 547 - RNA, 20 nt, Artificial Sequence
  spacer sequence
agccuggacaacaagagcga

SEQ ID NO: 548 - RNA, 20 nt, Artificial Sequence
  spacer sequence
caccacugcgcucuagccug

SEQ ID NO: 549 - RNA, 20 nt, Artificial Sequence
  spacer sequence
cggcucacugcaaccuccac

SEQ ID NO: 550 - RNA, 20 nt, Artificial Sequence
  spacer sequence
cugcaaccuccaccucccgg

SEQ ID NO: 551 - RNA, 20 nt, Artificial Sequence
  spacer sequence
accucccggguucaagcaau

SEQ ID NO: 552 - RNA, 20 nt, Artificial Sequence
  spacer sequence
cggguucaagcaauucuccu

SEQ ID NO: 553 - RNA, 20 nt, Artificial Sequence
  spacer sequence
agcaauucuccugccucagc

SEQ ID NO: 554 - RNA, 20 nt, Artificial Sequence
  spacer sequence
ccugccucagccuccugagu

SEQ ID NO: 555 - RNA, 20 nt, Artificial Sequence
  spacer sequence
ugccucagccuccugaguag

SEQ ID NO: 556 - RNA, 20 nt, Artificial Sequence
  spacer sequence
gccuccugaguagcugggau

SEQ ID NO: 557 - RNA, 20 nt, Artificial Sequence
  spacer sequence
ugaguagcugggauuacagg

SEQ ID NO: 558 - RNA, 20 nt, Artificial Sequence
  spacer sequence
ggaggcugaggcaggagaau

SEQ ID NO: 559 - RNA, 20 nt, Artificial Sequence
  spacer sequence
cagcuacucaggaggcugag

SEQ ID NO: 560 - RNA, 20 nt, Artificial Sequence
  spacer sequence
cagcuaauuuuguguacuuu

SEQ ID NO: 561 - RNA, 20 nt, Artificial Sequence
  spacer sequence
acuaaaaguacacaaaauua

SEQ ID NO: 562 - RNA, 20 nt, Artificial Sequence
  spacer sequence
cuacuaaaaguacacaaaau

SEQ ID NO: 563 - RNA, 20 nt, Artificial Sequence
  spacer sequence
cuguguuggccaggcugguc

SEQ ID NO: 564 - RNA, 20 nt, Artificial Sequence
  spacer sequence
ugaacuccugacuucuggug

SEQ ID NO: 565 - RNA, 20 nt, Artificial Sequence
  spacer sequence
agaccagccuggccaacaca

SEQ ID NO: 566 - RNA, 20 nt, Artificial Sequence
  spacer sequence
ugacuucuggugauccaccc

SEQ ID NO: 567 - RNA, 20 nt, Artificial Sequence
  spacer sequence
ggaguucaagaccagccugg

SEQ ID NO: 568 - RNA, 20 nt, Artificial Sequence
  spacer sequence
ggugauccacccucagccuc

SEQ ID NO: 569 - RNA, 20 nt, Artificial Sequence
  spacer sequence
ccagaagucaggaguucaag

SEQ ID NO: 570 - RNA, 20 nt, Artificial Sequence
  spacer sequence
acccucagccucccaacgug

SEQ ID NO: 571 - RNA, 20 nt, Artificial Sequence
  spacer sequence
gccucccaacgugcugggau

SEQ ID NO: 572 - RNA, 20 nt, Artificial Sequence
  spacer sequence
caacgugcugggauuacagg

SEQ ID NO: 573 - RNA, 20 nt, Artificial Sequence
  spacer sequence
cagcacguugggaggcugag

SEQ ID NO: 574 - RNA, 20 nt, Artificial Sequence
  spacer sequence
cgccuguaaucccagcacgu

SEQ ID NO: 575 - RNA, 20 nt, Artificial Sequence
  spacer sequence
ugcccagccuguuacuuucu

SEQ ID NO: 576 - RNA, 20 nt, Artificial Sequence
  spacer sequence
uuuuuagagauagggucuug

SEQ ID NO: 577 - RNA, 20 nt, Artificial Sequence
  spacer sequence
aaaaaagaaaguaacaggcu

SEQ ID NO: 578 - RNA, 20 nt, Artificial Sequence
  spacer sequence
cuaaaaaagaaaguaacagg

SEQ ID NO: 579 - RNA, 20 nt, Artificial Sequence
  spacer sequence
ugcuugucucacaggcugug

SEQ ID NO: 580 - RNA, 20 nt, Artificial Sequence
  spacer sequence
cacaggcuguguguaguggu

SEQ ID NO: 581 - RNA, 20 nt, Artificial Sequence
  spacer sequence
caggcuguguguagugguau

SEQ ID NO: 582 - RNA, 20 nt, Artificial Sequence
  spacer sequence
uaccacuacacacagccugu

SEQ ID NO: 583 - RNA, 20 nt, Artificial Sequence
  spacer sequence
aggaucucugcagccucaac

SEQ ID NO: 584 - RNA, 20 nt, Artificial Sequence
  spacer sequence
uugaucauaccacuacacac

SEQ ID NO: 585 - RNA, 20 nt, Artificial Sequence
  spacer sequence
cugcagccucaaccuucugu

SEQ ID NO: 586 - RNA, 20 nt, Artificial Sequence
  spacer sequence
gcagccucaaccuucugugc

SEQ ID NO: 587 - RNA, 20 nt, Artificial Sequence
  spacer sequence
accuucugugcucaagugau

SEQ ID NO: 588 - RNA, 20 nt, Artificial Sequence
  spacer sequence
gugcucaagugauccuccug

SEQ ID NO: 589 - RNA, 20 nt, Artificial Sequence
  spacer sequence
agugauccuccugcuucagc

SEQ ID NO: 590 - RNA, 20 nt, Artificial Sequence
  spacer sequence
cuugagcacagaagguugag

SEQ ID NO: 591 - RNA, 20 nt, Artificial Sequence
  spacer sequence
uccugcuucagcugccugag

SEQ ID NO: 592 - RNA, 20 nt, Artificial Sequence
  spacer sequence
ugcuucagcugccugaguag

SEQ ID NO: 593 - RNA, 20 nt, Artificial Sequence
  spacer sequence
gcugccugaguagcugggac

SEQ ID NO: 594 - RNA, 20 nt, Artificial Sequence
  spacer sequence
ggcagcugaagcaggaggau

SEQ ID NO: 595 - RNA, 20 nt, Artificial Sequence
  spacer sequence
cagcuacucaggcagcugaa

SEQ ID NO: 596 - RNA, 20 nt, Artificial Sequence
  spacer sequence
acuaaaaauuuaaaaauuag

SEQ ID NO: 597 - RNA, 20 nt, Artificial Sequence
  spacer sequence
cuacuaaaaauuuaaaaauu

SEQ ID NO: 598 - RNA, 20 nt, Artificial Sequence
  spacer sequence
cacuauguugcccaagcugg

SEQ ID NO: 599 - RNA, 20 nt, Artificial Sequence
  spacer sequence
cuauguugcccaagcugguc

SEQ ID NO: 600 - RNA, 20 nt, Artificial Sequence
  spacer sequence
caaacuccugagcucaagua

SEQ ID NO: 601 - RNA, 20 nt, Artificial Sequence
  spacer sequence
aacuccugagcucaaguaau

SEQ ID NO: 602 - RNA, 20 nt, Artificial Sequence
  spacer sequence
ugagcucaaguaauccuccc

SEQ ID NO: 603 - RNA, 20 nt, Artificial Sequence
  spacer sequence
ggaguuugagaccagcuugg

SEQ ID NO: 604 - RNA, 20 nt, Artificial Sequence
  spacer sequence
aguaauccucccgccucagc

SEQ ID NO: 605 - RNA, 20 nt, Artificial Sequence
  spacer sequence
ucccgccucagccucccaaa

SEQ ID NO: 606 - RNA, 20 nt, Artificial Sequence
  spacer sequence
cgccucagccucccaaagug

SEQ ID NO: 607 - RNA, 20 nt, Artificial Sequence
  spacer sequence
gccucccaaaguggugggau

SEQ ID NO: 608 - RNA, 20 nt, Artificial Sequence
  spacer sequence
caaaguggugggauuacacg

SEQ ID NO: 609 - RNA, 20 nt, Artificial Sequence
  spacer sequence
caccacuuugggaggcugag

SEQ ID NO: 610 - RNA, 20 nt, Artificial Sequence
  spacer sequence
cacguguaaucccaccacuu

SEQ ID NO: 611 - RNA, 20 nt, Artificial Sequence
  spacer sequence
uuguggcucacacguguaau

SEQ ID NO: 612 - RNA, 20 nt, Artificial Sequence
  spacer sequence
ggcacuuuuauuguaauccu

SEQ ID NO: 613 - RNA, 20 nt, Artificial Sequence
  spacer sequence
ugugggcuacucacugaggu

SEQ ID NO: 614 - RNA, 20 nt, Artificial Sequence
  spacer sequence
cugagguaaaccaaggcacc

SEQ ID NO: 615 - RNA, 20 nt, Artificial Sequence
  spacer sequence
gugaguagcccacaggauua

SEQ ID NO: 616 - RNA, 20 nt, Artificial Sequence
  spacer sequence
ccccaacuggucaaguggaa

SEQ ID NO: 617 - RNA, 20 nt, Artificial Sequence
  spacer sequence
aguggaauucuagggacaau

SEQ ID NO: 618 - RNA, 20 nt, Artificial Sequence
  spacer sequence
acuugaccaguuggggcgaa

SEQ ID NO: 619 - RNA, 20 nt, Artificial Sequence
  spacer sequence
agggacaaucacagcacagc

SEQ ID NO: 620 - RNA, 20 nt, Artificial Sequence
  spacer sequence
cuagaauuccacuugaccag

SEQ ID NO: 621 - RNA, 20 nt, Artificial Sequence
  spacer sequence
cagcacagcuguauaaacca

SEQ ID NO: 622 - RNA, 20 nt, Artificial Sequence
  spacer sequence
cuuuauuuuugugguuuaua

SEQ ID NO: 623 - RNA, 20 nt, Artificial Sequence
  spacer sequence
cguucacuuuauuuuugugg

SEQ ID NO: 624 - RNA, 20 nt, Artificial Sequence
  spacer sequence
uuggguucacguucacuuua

SEQ ID NO: 625 - RNA, 20 nt, Artificial Sequence
  spacer sequence
cuuuggguucacguucacuu

SEQ ID NO: 626 - RNA, 20 nt, Artificial Sequence
  spacer sequence
cucuuuggguucacguucac

SEQ ID NO: 627 - RNA, 20 nt, Artificial Sequence
  spacer sequence
cucucuuuggguucacguuc

SEQ ID NO: 628 - RNA, 20 nt, Artificial Sequence
  spacer sequence
cucucucuuuggguucacgu

SEQ ID NO: 629 - RNA, 20 nt, Artificial Sequence
  spacer sequence
aacgccuguuucucucucuc

SEQ ID NO: 630 - RNA, 20 nt, Artificial Sequence
  spacer sequence
gaaagacacuaaugguguca

SEQ ID NO: 631 - RNA, 20 nt, Artificial Sequence
  spacer sequence
gaaguuucaaacgccuguuu

SEQ ID NO: 632 - RNA, 20 nt, Artificial Sequence
  spacer sequence
uuccgaaguuucaaacgccu

SEQ ID NO: 633 - RNA, 20 nt, Artificial Sequence
  spacer sequence
cuucaacuaugauucuuaua

SEQ ID NO: 634 - RNA, 20 nt, Artificial Sequence
  spacer sequence
acuaugauucuuauaauuug

SEQ ID NO: 635 - RNA, 20 nt, Artificial Sequence
  spacer sequence
uaguugaagugacaccauua

SEQ ID NO: 636 - RNA, 20 nt, Artificial Sequence
  spacer sequence
uauaauuugcauaaaagcug

SEQ ID NO: 637 - RNA, 20 nt, Artificial Sequence
  spacer sequence
gcuuuuaugcaaauuauaag

SEQ ID NO: 638 - RNA, 20 nt, Artificial Sequence
  spacer sequence
cccaggcuggagugcagugg

SEQ ID NO: 639 - RNA, 20 nt, Artificial Sequence
  spacer sequence
ccgugucgcccaggcuggag

SEQ ID NO: 640 - RNA, 20 nt, Artificial Sequence
  spacer sequence
caccgugucgcccaggcugg

SEQ ID NO: 641 - RNA, 20 nt, Artificial Sequence
  spacer sequence
gccucaaaaaaaaaaaaaaa

SEQ ID NO: 642 - RNA, 20 nt, Artificial Sequence
  spacer sequence
aaaaaaaaaaaaaaaaaaaa

SEQ ID NO: 643 - RNA, 20 nt, Artificial Sequence
  spacer sequence
gccuuuuuuuuuuuuuuuuu

SEQ ID NO: 644 - RNA, 20 nt, Artificial Sequence
  spacer sequence
accuaugcgagaugacaggc

SEQ ID NO: 645 - RNA, 20 nt, Artificial Sequence
  spacer sequence
gugcacgccauuggccaccu

SEQ ID NO: 646 - RNA, 20 nt, Artificial Sequence
  spacer sequence
gucugugcacgccauuggcc

SEQ ID NO: 647 - RNA, 20 nt, Artificial Sequence
  spacer sequence
aguuggcgcgcgcgcgcggc

SEQ ID NO: 648 - RNA, 20 nt, Artificial Sequence
  spacer sequence
gcaucggugggauuggucgg

SEQ ID NO: 649 - RNA, 20 nt, Artificial Sequence
  spacer sequence
gugggauuggucggagguaa

SEQ ID NO: 650 - RNA, 20 nt, Artificial Sequence
  spacer sequence
caccgaugccgagccgcgcg

SEQ ID NO: 651 - RNA, 20 nt, Artificial Sequence
  spacer sequence
gagguaaaggauuuuccugc

SEQ ID NO: 652 - RNA, 20 nt, Artificial Sequence
  spacer sequence
gaccaaucccaccgaugccg

SEQ ID NO: 653 - RNA, 20 nt, Artificial Sequence
  spacer sequence
uuuaccuccgaccaauccca

SEQ ID NO: 654 - RNA, 20 nt, Artificial Sequence
  spacer sequence
ugccaccuaaggcggagagg

SEQ ID NO: 655 - RNA, 20 nt, Artificial Sequence
  spacer sequence
gccuuagguggcaggaaaau

SEQ ID NO: 656 - RNA, 20 nt, Artificial Sequence
  spacer sequence
ccgccuuagguggcaggaaa

SEQ ID NO: 657 - RNA, 20 nt, Artificial Sequence
  spacer sequence
ucuccgccuuagguggcagg

SEQ ID NO: 658 - RNA, 20 nt, Artificial Sequence
  spacer sequence
cccuuccucuccgccuuagg

SEQ ID NO: 659 - RNA, 20 nt, Artificial Sequence
  spacer sequence
aaacgggggaggcgaagagu

SEQ ID NO: 660 - RNA, 20 nt, Artificial Sequence
  spacer sequence
aucccccuuccucuccgccu

SEQ ID NO: 661 - RNA, 20 nt, Artificial Sequence
  spacer sequence
cccguuucgaucccccuucc

SEQ ID NO: 662 - RNA, 20 nt, Artificial Sequence
  spacer sequence
ccucccccguuucgaucccc

SEQ ID NO: 663 - RNA, 20 nt, Artificial Sequence
  spacer sequence
ucgccucccccguuucgauc

SEQ ID NO: 664 - RNA, 20 nt, Artificial Sequence
  spacer sequence
aaaaauguugugccugggac

SEQ ID NO: 665 - RNA, 20 nt, Artificial Sequence
  spacer sequence
caggcacaacauuuuuugac

SEQ ID NO: 666 - RNA, 20 nt, Artificial Sequence
  spacer sequence
ggcgcgggaggcgugugccu

SEQ ID NO: 667 - RNA, 20 nt, Artificial Sequence
  spacer sequence
cgcgccagaccacuuguccc

SEQ ID NO: 668 - RNA, 20 nt, Artificial Sequence
  spacer sequence
agggggagacaggaacuuuu

SEQ ID NO: 669 - RNA, 20 nt, Artificial Sequence
  spacer sequence
cccuagagccaggcacacgc

SEQ ID NO: 670 - RNA, 20 nt, Artificial Sequence
  spacer sequence
cccccuagagccaggcacac

SEQ ID NO: 671 - RNA, 20 nt, Artificial Sequence
  spacer sequence
ugucucccccuagagccagg

SEQ ID NO: 672 - RNA, 20 nt, Artificial Sequence
  spacer sequence
uaaaaaaguuccugucuccc

SEQ ID NO: 673 - RNA, 20 nt, Artificial Sequence
  spacer sequence
cguaaaaaaguuccugucuc

SEQ ID NO: 674 - RNA, 20 nt, Artificial Sequence
  spacer sequence
cucguaaaaaaguuccuguc

SEQ ID NO: 675 - RNA, 20 nt, Artificial Sequence
  spacer sequence
uaacgcaaucccuucccgug

SEQ ID NO: 676 - RNA, 20 nt, Artificial Sequence
  spacer sequence
cuucccguggaugcuagagg

SEQ ID NO: 677 - RNA, 20 nt, Artificial Sequence
  spacer sequence
uaccacauacaguugguacg

SEQ ID NO: 678 - RNA, 20 nt, Artificial Sequence
  spacer sequence
uaccaacuguaugugguaug

SEQ ID NO: 679 - RNA, 20 nt, Artificial Sequence
  spacer sequence
ucguaccaacuguauguggu

SEQ ID NO: 680 - RNA, 20 nt, Artificial Sequence
  spacer sequence
uccucguaccaacuguaugu

SEQ ID NO: 681 - RNA, 20 nt, Artificial Sequence
  spacer sequence
uucauccucguaccaacugu

SEQ ID NO: 682 - RNA, 20 nt, Artificial Sequence
  spacer sequence
caaagugcuaggauuacagg

SEQ ID NO: 683 - RNA, 20 nt, Artificial Sequence
  spacer sequence
uggccucccaaagugcuagg

SEQ ID NO: 684 - RNA, 20 nt, Artificial Sequence
  spacer sequence
gcccaucuuggccucccaaa

SEQ ID NO: 685 - RNA, 20 nt, Artificial Sequence
  spacer sequence
ggcaaucugcccaucuuggc

SEQ ID NO: 686 - RNA, 20 nt, Artificial Sequence
  spacer sequence
ggaguuugagaccagccugg

SEQ ID NO: 687 - RNA, 20 nt, Artificial Sequence
  spacer sequence
ugagcucaggcaaucugccc

SEQ ID NO: 688 - RNA, 20 nt, Artificial Sequence
  spacer sequence
aacuccugagcucaggcaau

SEQ ID NO: 689 - RNA, 20 nt, Artificial Sequence
  spacer sequence
caaacuccugagcucaggca

SEQ ID NO: 690 - RNA, 20 nt, Artificial Sequence
  spacer sequence
ccguguugcccaggcugguc

SEQ ID NO: 691 - RNA, 20 nt, Artificial Sequence
  spacer sequence
cuacuaaaaauacaaaaaau

SEQ ID NO: 692 - RNA, 20 nt, Artificial Sequence
  spacer sequence
acuaaaaauacaaaaaauua

SEQ ID NO: 693 - RNA, 20 nt, Artificial Sequence
  spacer sequence
guggcagaacccagcaccau

SEQ ID NO: 694 - RNA, 20 nt, Artificial Sequence
  spacer sequence
acuucaguggcagaacccag

SEQ ID NO: 695 - RNA, 20 nt, Artificial Sequence
  spacer sequence
gucaacuucaguggcagaac

SEQ ID NO: 696 - RNA, 20 nt, Artificial Sequence
  spacer sequence
agccuuuggguaccuuuauu

SEQ ID NO: 697 - RNA, 20 nt, Artificial Sequence
  spacer sequence
caccuguaaucccagcacuc

SEQ ID NO: 698 - RNA, 20 nt, Artificial Sequence
  spacer sequence
uucuugaccucgcaaaccua

SEQ ID NO: 699 - RNA, 20 nt, Artificial Sequence
  spacer sequence
ugaccucgcaaaccuaaaaa

SEQ ID NO: 700 - RNA, 20 nt, Artificial Sequence
  spacer sequence
agaaagauacccaggccagg

SEQ ID NO: 701 - RNA, 20 nt, Artificial Sequence
  spacer sequence
caaaccuaaaaagcuacugc

SEQ ID NO: 702 - RNA, 20 nt, Artificial Sequence
  spacer sequence
gugcuguuucuugucuccgc

SEQ ID NO: 703 - RNA, 20 nt, Artificial Sequence
  spacer sequence
cuacuucacacuggcaaaga

SEQ ID NO: 704 - RNA, 20 nt, Artificial Sequence
  spacer sequence
cacuggcaaagagaaugggg

SEQ ID NO: 705 - RNA, 20 nt, Artificial Sequence
  spacer sequence
uugccagugugaaguagcga

SEQ ID NO: 706 - RNA, 20 nt, Artificial Sequence
  spacer sequence
cuuugccagugugaaguagc

SEQ ID NO: 707 - RNA, 20 nt, Artificial Sequence
  spacer sequence
aaaugccccauucucuuugc

SEQ ID NO: 708 - RNA, 20 nt, Artificial Sequence
  spacer sequence
guauuuuaaucaaaaugccc

SEQ ID NO: 709 - RNA, 20 nt, Artificial Sequence
  spacer sequence
ggccgaguauucugacaucu

SEQ ID NO: 710 - RNA, 20 nt, Artificial Sequence
  spacer sequence
gccagauggcauuugucugu

SEQ ID NO: 711 - RNA, 20 nt, Artificial Sequence
  spacer sequence
gacaucuuaucuccugaggg

SEQ ID NO: 712 - RNA, 20 nt, Artificial Sequence
  spacer sequence
gaauacucggccagauggca

SEQ ID NO: 713 - RNA, 20 nt, Artificial Sequence
  spacer sequence
uaucuccugagggcacuguu

SEQ ID NO: 714 - RNA, 20 nt, Artificial Sequence
  spacer sequence
ccugagggcacuguugacau

SEQ ID NO: 715 - RNA, 20 nt, Artificial Sequence
  spacer sequence
ugagggcacuguugacaucu

SEQ ID NO: 716 - RNA, 20 nt, Artificial Sequence
  spacer sequence
ggagauaagaugucagaaua

SEQ ID NO: 717 - RNA, 20 nt, Artificial Sequence
  spacer sequence
acagugcccucaggagauaa

SEQ ID NO: 718 - RNA, 20 nt, Artificial Sequence
  spacer sequence
aaagagaacauggaauuggc

SEQ ID NO: 719 - RNA, 20 nt, Artificial Sequence
  spacer sequence
uuagaugucaacagugcccu

SEQ ID NO: 720 - RNA, 20 nt, Artificial Sequence
  spacer sequence
cuuuagaugucaacagugcc

SEQ ID NO: 721 - RNA, 20 nt, Artificial Sequence
  spacer sequence
auguucucuuuagaugucaa

SEQ ID NO: 722 - RNA, 20 nt, Artificial Sequence
  spacer sequence
uuuaaugccaauuccauguu

SEQ ID NO: 723 - RNA, 20 nt, Artificial Sequence
  spacer sequence
gcggaucagcagcaguggca

SEQ ID NO: 724 - RNA, 20 nt, Artificial Sequence
  spacer sequence
gcagacuacacuuuggguag

SEQ ID NO: 725 - RNA, 20 nt, Artificial Sequence
  spacer sequence
gcagcaguggcaucgccugg

SEQ ID NO: 726 - RNA, 20 nt, Artificial Sequence
  spacer sequence
ccuggugucagaaacacaau

SEQ ID NO: 727 - RNA, 20 nt, Artificial Sequence
  spacer sequence
gaaacacaaucccagacacc

SEQ ID NO: 728 - RNA, 20 nt, Artificial Sequence
  spacer sequence
gacaccaggcgaugccacug

SEQ ID NO: 729 - RNA, 20 nt, Artificial Sequence
  spacer sequence
cagacaccaagccagacacu

SEQ ID NO: 730 - RNA, 20 nt, Artificial Sequence
  spacer sequence
gggauuguguuucugacacc

SEQ ID NO: 731 - RNA, 20 nt, Artificial Sequence
  spacer sequence
ggcuuggugucugggauugu

SEQ ID NO: 732 - RNA, 20 nt, Artificial Sequence
  spacer sequence
aaucuacgucuuaacacuca

SEQ ID NO: 733 - RNA, 20 nt, Artificial Sequence
  spacer sequence
agugaucugcccaccucggc

SEQ ID NO: 734 - RNA, 20 nt, Artificial Sequence
  spacer sequence
cuugaggccacgaguuugag

SEQ ID NO: 735 - RNA, 20 nt, Artificial Sequence
  spacer sequence
gcccaccucggccccccaaa

SEQ ID NO: 736 - RNA, 20 nt, Artificial Sequence
  spacer sequence
gccccccaaagugcugggau

SEQ ID NO: 737 - RNA, 20 nt, Artificial Sequence
  spacer sequence
cagcacuuuggggggccgag

SEQ ID NO: 738 - RNA, 20 nt, Artificial Sequence
  spacer sequence
ucacuucuuugaaaaugcaa

SEQ ID NO: 739 - RNA, 20 nt, Artificial Sequence
  spacer sequence
cuucuuugaaaaugcaaaac

SEQ ID NO: 740 - RNA, 20 nt, Artificial Sequence
  spacer sequence
uuuaccaagcaguuguuuuu

SEQ ID NO: 741 - RNA, 20 nt, Artificial Sequence
  spacer sequence
aggcuuucuuaccugaggac

SEQ ID NO: 742 - RNA, 20 nt, Artificial Sequence
  spacer sequence
uaccugaggacagauuuuug

SEQ ID NO: 743 - RNA, 20 nt, Artificial Sequence
  spacer sequence
gguaagaaagccuugauuaa

SEQ ID NO: 744 - RNA, 20 nt, Artificial Sequence
  spacer sequence
ucagguaagaaagccuugau

SEQ ID NO: 745 - RNA, 20 nt, Artificial Sequence
  spacer sequence
guccucagguaagaaagccu

SEQ ID NO: 746 - RNA, 20 nt, Artificial Sequence
  spacer sequence
caaaaaucuguccucaggua

SEQ ID NO: 747 - RNA, 20 nt, Artificial Sequence
  spacer sequence
ggugaaaggaccuagaaaag

SEQ ID NO: 748 - RNA, 20 nt, Artificial Sequence
  spacer sequence
cccgacucccaaaaaucugu

SEQ ID NO: 749 - RNA, 20 nt, Artificial Sequence
  spacer sequence
uuucacccgacucccaaaaa

SEQ ID NO: 750 - RNA, 20 nt, Artificial Sequence
  spacer sequence
agguccuuucacccgacucc

SEQ ID NO: 751 - RNA, 20 nt, Artificial Sequence
  spacer sequence
uuguaauuugcuuuauugca

SEQ ID NO: 752 - RNA, 20 nt, Artificial Sequence
  spacer sequence
guguuuucacugaaauggca

SEQ ID NO: 753 - RNA, 20 nt, Artificial Sequence
  spacer sequence
cugaaauggcaguuuaugga

SEQ ID NO: 754 - RNA, 20 nt, Artificial Sequence
  spacer sequence
gugaaaacacagaaaauaaa

SEQ ID NO: 755 - RNA, 20 nt, Artificial Sequence
  spacer sequence
auaaacugccauuucaguga

SEQ ID NO: 756 - RNA, 20 nt, Artificial Sequence
  spacer sequence
ccauaaacugccauuucagu

SEQ ID NO: 757 - RNA, 20 nt, Artificial Sequence
  spacer sequence
cccacuuggcugugaacagg

SEQ ID NO: 758 - RNA, 20 nt, Artificial Sequence
  spacer sequence
cacuuggcugugaacaggcu

SEQ ID NO: 759 - RNA, 20 nt, Artificial Sequence
  spacer sequence
cagccaagugggagaguuuc

SEQ ID NO: 760 - RNA, 20 nt, Artificial Sequence
  spacer sequence
aagcaacagcaacacuucug

SEQ ID NO: 761 - RNA, 20 nt, Artificial Sequence
  spacer sequence
gcagaauuggcagggacagu

SEQ ID NO: 762 - RNA, 20 nt, Artificial Sequence
  spacer sequence
gcagaaguguugcuguugcu

SEQ ID NO: 763 - RNA, 20 nt, Artificial Sequence
  spacer sequence
cugccaauucugcagaagug

SEQ ID NO: 764 - RNA, 20 nt, Artificial Sequence
  spacer sequence
auagcacugucccugccaau

SEQ ID NO: 765 - RNA, 20 nt, Artificial Sequence
  spacer sequence
caaacuucaaggcaaaggga

SEQ ID NO: 766 - RNA, 20 nt, Artificial Sequence
  spacer sequence
aggcaaagggacaaacaaac

SEQ ID NO: 767 - RNA, 20 nt, Artificial Sequence
  spacer sequence
cuuugccuugaaguuuguga

SEQ ID NO: 768 - RNA, 20 nt, Artificial Sequence
  spacer sequence
aaauguauuuucagaggaaa

SEQ ID NO: 769 - RNA, 20 nt, Artificial Sequence
  spacer sequence
uucuguuaggcugggggagc

SEQ ID NO: 770 - RNA, 20 nt, Artificial Sequence
  spacer sequence
augucauucuguuaggcugg

SEQ ID NO: 771 - RNA, 20 nt, Artificial Sequence
  spacer sequence
agccuuuuccaugucauucu

SEQ ID NO: 772 - RNA, 20 nt, Artificial Sequence
  spacer sequence
gcaaaacaaucccuaggcuu

SEQ ID NO: 773 - RNA, 20 nt, Artificial Sequence
  spacer sequence
cuaggcuuagagacgcugcu

SEQ ID NO: 774 - RNA, 20 nt, Artificial Sequence
  spacer sequence
aagccuagggauuguuuugc

SEQ ID NO: 775 - RNA, 20 nt, Artificial Sequence
  spacer sequence
cuaagccuagggauuguuuu

SEQ ID NO: 776 - RNA, 20 nt, Artificial Sequence
  spacer sequence
acaggcaagcaaacugggac

SEQ ID NO: 777 - RNA, 20 nt, Artificial Sequence
  spacer sequence
gaccuuucuucugucccuua

SEQ ID NO: 778 - RNA, 20 nt, Artificial Sequence
  spacer sequence
gauuuagggcagagucugcu

SEQ ID NO: 779 - RNA, 20 nt, Artificial Sequence
  spacer sequence
ucugucccuuaccagcugug

SEQ ID NO: 780 - RNA, 20 nt, Artificial Sequence
  spacer sequence
gucccuuaccagcuguguga

SEQ ID NO: 781 - RNA, 20 nt, Artificial Sequence
  spacer sequence
cuuaccagcugugugaccuu

SEQ ID NO: 782 - RNA, 20 nt, Artificial Sequence
  spacer sequence
cacagcugguaagggacaga

SEQ ID NO: 783 - RNA, 20 nt, Artificial Sequence
  spacer sequence
cugugcuucauugcccucau

SEQ ID NO: 784 - RNA, 20 nt, Artificial Sequence
  spacer sequence
gugcuucauugcccucaucu

SEQ ID NO: 785 - RNA, 20 nt, Artificial Sequence
  spacer sequence
uugcccucaucuguaaaaug

SEQ ID NO: 786 - RNA, 20 nt, Artificial Sequence
  spacer sequence
ucuguaaaaugaggcuuaua

SEQ ID NO: 787 - RNA, 20 nt, Artificial Sequence
  spacer sequence
guaaaaugaggcuuauaggc

SEQ ID NO: 788 - RNA, 20 nt, Artificial Sequence
  spacer sequence
uuuuacagaugagggcaaug

SEQ ID NO: 789 - RNA, 20 nt, Artificial Sequence
  spacer sequence
gugggauuuguuuauucuug

SEQ ID NO: 790 - RNA, 20 nt, Artificial Sequence
  spacer sequence
cuucuuccauuuuucagaca

SEQ ID NO: 791 - RNA, 20 nt, Artificial Sequence
  spacer sequence
ucuuccauuuuucagacagg

SEQ ID NO: 792 - RNA, 20 nt, Artificial Sequence
  spacer sequence
uccauuuuucagacaggcag

SEQ ID NO: 793 - RNA, 20 nt, Artificial Sequence
  spacer sequence
auuuuucagacaggcaguuc

SEQ ID NO: 794 - RNA, 20 nt, Artificial Sequence
  spacer sequence
gacaggcaguucuuagccuu

SEQ ID NO: 795 - RNA, 20 nt, Artificial Sequence
  spacer sequence
gaaaaauggaagaagagauc

SEQ ID NO: 796 - RNA, 20 nt, Artificial Sequence
  spacer sequence
uagccuuaccaucuaaugga

SEQ ID NO: 797 - RNA, 20 nt, Artificial Sequence
  spacer sequence
aauggagguacugcccaggc

SEQ ID NO: 798 - RNA, 20 nt, Artificial Sequence
  spacer sequence
auuagaugguaaggcuaaga

SEQ ID NO: 799 - RNA, 20 nt, Artificial Sequence
  spacer sequence
agccugggcaguaccuccau

SEQ ID NO: 800 - RNA, 20 nt, Artificial Sequence
  spacer sequence
uccagccugggcaguaccuc

SEQ ID NO: 801 - RNA, 20 nt, Artificial Sequence
  spacer sequence
ccaaauacagccauauuaug

SEQ ID NO: 802 - RNA, 20 nt, Artificial Sequence
  spacer sequence
aaauacagccauauuaugag

SEQ ID NO: 803 - RNA, 20 nt, Artificial Sequence
  spacer sequence
uaauauggcuguauuuggag

SEQ ID NO: 804 - RNA, 20 nt, Artificial Sequence
  spacer sequence
ucauaauauggcuguauuug

SEQ ID NO: 805 - RNA, 20 nt, Artificial Sequence
  spacer sequence
acggaugaauuuugaagggg

SEQ ID NO: 806 - RNA, 20 nt, Artificial Sequence
  spacer sequence
guugaagcccuaacccccag

SEQ ID NO: 807 - RNA, 20 nt, Artificial Sequence
  spacer sequence
uccguugaagcccuaacccc

SEQ ID NO: 808 - RNA, 20 nt, Artificial Sequence
  spacer sequence
aaauucauccguugaagccc

SEQ ID NO: 809 - RNA, 20 nt, Artificial Sequence
  spacer sequence
agccauaacaaguacccaac

SEQ ID NO: 810 - RNA, 20 nt, Artificial Sequence
  spacer sequence
ucuauaugcuguaaagaaua

SEQ ID NO: 811 - RNA, 20 nt, Artificial Sequence
  spacer sequence
auaugcuguaaagaauaagc

SEQ ID NO: 812 - RNA, 20 nt, Artificial Sequence
  spacer sequence
gcauguaaguuaauuuuucc

SEQ ID NO: 813 - RNA, 20 nt, Artificial Sequence
  spacer sequence
ccgucuaaaacaagugcugc

SEQ ID NO: 814 - RNA, 20 nt, Artificial Sequence
  spacer sequence
aaaacaagugcugcuuuuau

SEQ ID NO: 815 - RNA, 20 nt, Artificial Sequence
  spacer sequence
ucucaaaacucaugguaugu

SEQ ID NO: 816 - RNA, 20 nt, Artificial Sequence
  spacer sequence
caaaacucaugguauguaag

SEQ ID NO: 817 - RNA, 20 nt, Artificial Sequence
  spacer sequence
aaacucaugguauguaagaa

SEQ ID NO: 818 - RNA, 20 nt, Artificial Sequence
  spacer sequence
ugguauguaagaagcaacau

SEQ ID NO: 819 - RNA, 20 nt, Artificial Sequence
  spacer sequence
uacauaccaugaguuuugag

SEQ ID NO: 820 - RNA, 20 nt, Artificial Sequence
  spacer sequence
gucgaaaaaaaaaaguguuu

SEQ ID NO: 821 - RNA, 20 nt, Artificial Sequence
  spacer sequence
aaaaaaaaaaguguuucaug

SEQ ID NO: 822 - RNA, 20 nt, Artificial Sequence
  spacer sequence
acagaaaggauuauuuuggg

SEQ ID NO: 823 - RNA, 20 nt, Artificial Sequence
  spacer sequence
uguaauaaacacugguucua

SEQ ID NO: 824 - RNA, 20 nt, Artificial Sequence
  spacer sequence
aauccuaagagaaaauauau

SEQ ID NO: 825 - RNA, 20 nt, Artificial Sequence
  spacer sequence
uaagagaaaauauauagaaa

SEQ ID NO: 826 - RNA, 20 nt, Artificial Sequence
  spacer sequence
uaggauuagaaccaguguuu

SEQ ID NO: 827 - RNA, 20 nt, Artificial Sequence
  spacer sequence
cuuaggauuagaaccagugu

SEQ ID NO: 828 - RNA, 20 nt, Artificial Sequence
  spacer sequence
auauauuuucucuuaggauu

SEQ ID NO: 829 - RNA, 20 nt, Artificial Sequence
  spacer sequence
ccauuguuuuuaaugucaac

SEQ ID NO: 830 - RNA, 20 nt, Artificial Sequence
  spacer sequence
auuguuuuuaaugucaacaa

SEQ ID NO: 831 - RNA, 20 nt, Artificial Sequence
  spacer sequence
acaaaucagacaaccuuuua

SEQ ID NO: 832 - RNA, 20 nt, Artificial Sequence
  spacer sequence
gacaaccuuuuagucaacca

SEQ ID NO: 833 - RNA, 20 nt, Artificial Sequence
  spacer sequence
gauuuguugacauuaaaaac

SEQ ID NO: 834 - RNA, 20 nt, Artificial Sequence
  spacer sequence
accaaaaacaaucucucaau

SEQ ID NO: 835 - RNA, 20 nt, Artificial Sequence
  spacer sequence
cucaauuacacauaccuaga

SEQ ID NO: 836 - RNA, 20 nt, Artificial Sequence
  spacer sequence
caauuacacauaccuagaua

SEQ ID NO: 837 - RNA, 20 nt, Artificial Sequence
  spacer sequence
auuacacauaccuagauaug

SEQ ID NO: 838 - RNA, 20 nt, Artificial Sequence
  spacer sequence
agguauguguaauugagaga

SEQ ID NO: 839 - RNA, 20 nt, Artificial Sequence
  spacer sequence
cuacauaucuagguaugugu

SEQ ID NO: 840 - RNA, 20 nt, Artificial Sequence
  spacer sequence
uauucacuacauaucuaggu

SEQ ID NO: 841 - RNA, 20 nt, Artificial Sequence
  spacer sequence
aauucauauucacuacauau

SEQ ID NO: 842 - RNA, 20 nt, Artificial Sequence
  spacer sequence
uuuucaaauucauauucacu

SEQ ID NO: 843 - RNA, 20 nt, Artificial Sequence
  spacer sequence
ucauuuucaaauucauauuc

SEQ ID NO: 844 - RNA, 20 nt, Artificial Sequence
  spacer sequence
ccucauuuucaaauucauau

SEQ ID NO: 845 - RNA, 20 nt, Artificial Sequence
  spacer sequence
aaugcaauauaccccaucca

SEQ ID NO: 846 - RNA, 20 nt, Artificial Sequence
  spacer sequence
agcacagccacuguguaacu

SEQ ID NO: 847 - RNA, 20 nt, Artificial Sequence
  spacer sequence
uuacaaauguuuaccagcgc

SEQ ID NO: 848 - RNA, 20 nt, Artificial Sequence
  spacer sequence
gugacauuugugacauuuua

SEQ ID NO: 849 - RNA, 20 nt, Artificial Sequence
  spacer sequence
cugaaguugguuucuuuaca

SEQ ID NO: 850 - RNA, 20 nt, Artificial Sequence
  spacer sequence
caaaugucacugaaguuggu

SEQ ID NO: 851 - RNA, 20 nt, Artificial Sequence
  spacer sequence
uuaaaaugucacaaauguca

SEQ ID NO: 852 - RNA, 20 nt, Artificial Sequence
  spacer sequence
aauuacucuuuaaaauguca

SEQ ID NO: 853 - RNA, 20 nt, Artificial Sequence
  spacer sequence
uaacaaacauccaauuacuc

SEQ ID NO: 854 - RNA, 20 nt, Artificial Sequence
  spacer sequence
gagucuuuaauaugaaccaa

SEQ ID NO: 855 - RNA, 20 nt, Artificial Sequence
  spacer sequence
gauucauaacaaacauccaa

SEQ ID NO: 856 - RNA, 20 nt, Artificial Sequence
  spacer sequence
uuaauaugaaccaaccauaa

SEQ ID NO: 857 - RNA, 20 nt, Artificial Sequence
  spacer sequence
uauuaaagacucagauucau

SEQ ID NO: 858 - RNA, 20 nt, Artificial Sequence
  spacer sequence
uaugguugguucauauuaaa

SEQ ID NO: 859 - RNA, 20 nt, Artificial Sequence
  spacer sequence
guuuaaaaucauuacucuuu

SEQ ID NO: 860 - RNA, 20 nt, Artificial Sequence
  spacer sequence
uuacucuuuuugcuagagag

SEQ ID NO: 861 - RNA, 20 nt, Artificial Sequence
  spacer sequence
uuuugcuagagagcacuaua

SEQ ID NO: 862 - RNA, 20 nt, Artificial Sequence
  spacer sequence
agcaaaaagaguaaugauuu

SEQ ID NO: 863 - RNA, 20 nt, Artificial Sequence
  spacer sequence
cuagcaaaaagaguaaugau

SEQ ID NO: 864 - RNA, 20 nt, Artificial Sequence
  spacer sequence
gcaaacccaagccauucaag

SEQ ID NO: 865 - RNA, 20 nt, Artificial Sequence
  spacer sequence
aguuucacaaauagguguuu

SEQ ID NO: 866 - RNA, 20 nt, Artificial Sequence
  spacer sequence
cucuccucuuuuccguaaga

SEQ ID NO: 867 - RNA, 20 nt, Artificial Sequence
  spacer sequence
cuccucuuuuccguaagagu

SEQ ID NO: 868 - RNA, 20 nt, Artificial Sequence
  spacer sequence
ccucuuuuccguaagaguug

SEQ ID NO: 869 - RNA, 20 nt, Artificial Sequence
  spacer sequence
ucuuuuccguaagaguugug

SEQ ID NO: 870 - RNA, 20 nt, Artificial Sequence
  spacer sequence
uuuccguaagaguuguggca

SEQ ID NO: 871 - RNA, 20 nt, Artificial Sequence
  spacer sequence
guaagaguuguggcagccau

SEQ ID NO: 872 - RNA, 20 nt, Artificial Sequence
  spacer sequence
uacggaaaagaggagagaga

SEQ ID NO: 873 - RNA, 20 nt, Artificial Sequence
  spacer sequence
ugaaguucugaagugaaaau

SEQ ID NO: 874 - RNA, 20 nt, Artificial Sequence
  spacer sequence
ugauggcugccacaacucuu

SEQ ID NO: 875 - RNA, 20 nt, Artificial Sequence
  spacer sequence
gaagugaaaauccaacuaac

SEQ ID NO: 876 - RNA, 20 nt, Artificial Sequence
  spacer sequence
gaacuucaugauggcugcca

SEQ ID NO: 877 - RNA, 20 nt, Artificial Sequence
  spacer sequence
cuucagaacuucaugauggc

SEQ ID NO: 878 - RNA, 20 nt, Artificial Sequence
  spacer sequence
aacuaaccaggaauaaagug

SEQ ID NO: 879 - RNA, 20 nt, Artificial Sequence
  spacer sequence
ugguuaguuggauuuucacu

SEQ ID NO: 880 - RNA, 20 nt, Artificial Sequence
  spacer sequence
cuuuauuccugguuaguugg

SEQ ID NO: 881 - RNA, 20 nt, Artificial Sequence
  spacer sequence
uuuucacuuuauuccugguu

SEQ ID NO: 882 - RNA, 20 nt, Artificial Sequence
  spacer sequence
cuuuuucacuuuauuccugg

SEQ ID NO: 883 - RNA, 20 nt, Artificial Sequence
  spacer sequence
cauauccauacucucuuuuu

SEQ ID NO: 884 - RNA, 20 nt, Artificial Sequence
  spacer sequence
auuaccagacuaucucugga

SEQ ID NO: 885 - RNA, 20 nt, Artificial Sequence
  spacer sequence
accauguuaucccauaucca

SEQ ID NO: 886 - RNA, 20 nt, Artificial Sequence
  spacer sequence
gguaaucgaccauguuaucc

SEQ ID NO: 887 - RNA, 20 nt, Artificial Sequence
  spacer sequence
cuggaaauguuuacuuccac

SEQ ID NO: 888 - RNA, 20 nt, Artificial Sequence
  spacer sequence
ggaaauguuuacuuccaccc

SEQ ID NO: 889 - RNA, 20 nt, Artificial Sequence
  spacer sequence
agagauagucugguaaucga

SEQ ID NO: 890 - RNA, 20 nt, Artificial Sequence
  spacer sequence
acccuuuuuacugagagaga

SEQ ID NO: 891 - RNA, 20 nt, Artificial Sequence
  spacer sequence
guaaaaaggguggaaguaaa

SEQ ID NO: 892 - RNA, 20 nt, Artificial Sequence
  spacer sequence
caguaaaaaggguggaagua

SEQ ID NO: 893 - RNA, 20 nt, Artificial Sequence
  spacer sequence
cucaguaaaaaggguggaag

SEQ ID NO: 894 - RNA, 20 nt, Artificial Sequence
  spacer sequence
cucucaguaaaaagggugga

SEQ ID NO: 895 - RNA, 20 nt, Artificial Sequence
  spacer sequence
ucucucucaguaaaaagggu

SEQ ID NO: 896 - RNA, 20 nt, Artificial Sequence
  spacer sequence
cuaagcugguuuuaauuaua

SEQ ID NO: 897 - RNA, 20 nt, Artificial Sequence
  spacer sequence
aagcugguuuuaauuauauu

SEQ ID NO: 898 - RNA, 20 nt, Artificial Sequence
  spacer sequence
cccaaacucuuuaucaauua

SEQ ID NO: 899 - RNA, 20 nt, Artificial Sequence
  spacer sequence
auuuaaaauaacaaaaaaua

SEQ ID NO: 900 - RNA, 20 nt, Artificial Sequence
  spacer sequence
uauuuuuuguuauuuuaaau

SEQ ID NO: 901 - RNA, 20 nt, Artificial Sequence
  spacer sequence
cuuauuuuuuguuauuuuaa

SEQ ID NO: 902 - RNA, 20 nt, Artificial Sequence
  spacer sequence
gccaggcauggugguucaca

SEQ ID NO: 903 - RNA, 20 nt, Artificial Sequence
  spacer sequence
caccuauaauccuagcacuu

SEQ ID NO: 904 - RNA, 20 nt, Artificial Sequence
  spacer sequence
uuuuuuuuuuuuuuuuuuua

SEQ ID NO: 905 - RNA, 20 nt, Artificial Sequence
  spacer sequence
cuuuuuuuuuuuuuuuuuuu

SEQ ID NO: 906 - RNA, 20 nt, Artificial Sequence
  spacer sequence
cucuuuuuuuuuuuuuuuuu

SEQ ID NO: 907 - RNA, 20 nt, Artificial Sequence
  spacer sequence
cucucuuuuuuuuuuuuuuu

SEQ ID NO: 908 - RNA, 20 nt, Artificial Sequence
  spacer sequence
cuacaauuuagaaaaagcuu

SEQ ID NO: 909 - RNA, 20 nt, Artificial Sequence
  spacer sequence
aaauuguagggaauucucuc

SEQ ID NO: 910 - RNA, 20 nt, Artificial Sequence
  spacer sequence
uguguuaauaauaauaucuu

SEQ ID NO: 911 - RNA, 20 nt, Artificial Sequence
  spacer sequence
ucaggccaggcucagugguu

SEQ ID NO: 912 - RNA, 20 nt, Artificial Sequence
  spacer sequence
ggccaggcucagugguucac

SEQ ID NO: 913 - RNA, 20 nt, Artificial Sequence
  spacer sequence
acccgccucggccuccugaa

SEQ ID NO: 914 - RNA, 20 nt, Artificial Sequence
  spacer sequence
agaguucaagaccagccugg

SEQ ID NO: 915 - RNA, 20 nt, Artificial Sequence
  spacer sequence
ugagcuuaaggcaucuaccc

SEQ ID NO: 916 - RNA, 20 nt, Artificial Sequence
  spacer sequence
agaccagccugggcaagaug

SEQ ID NO: 917 - RNA, 20 nt, Artificial Sequence
  spacer sequence
ugaacucuugagcuuaaggc

SEQ ID NO: 918 - RNA, 20 nt, Artificial Sequence
  spacer sequence
ugcccaggcuggucuugaac

SEQ ID NO: 919 - RNA, 20 nt, Artificial Sequence
  spacer sequence
aucucuacaaaaaauuagcc

SEQ ID NO: 920 - RNA, 20 nt, Artificial Sequence
  spacer sequence
cuacaaaaaauuagccgcag

SEQ ID NO: 921 - RNA, 20 nt, Artificial Sequence
  spacer sequence
acaaaaaauuagccgcaggu

SEQ ID NO: 922 - RNA, 20 nt, Artificial Sequence
  spacer sequence
cgaacucccgaccuugugau

SEQ ID NO: 923 - RNA, 20 nt, Artificial Sequence
  spacer sequence
aacucccgaccuugugaucc

SEQ ID NO: 924 - RNA, 20 nt, Artificial Sequence
  spacer sequence
agaccagccuggccaauaug

SEQ ID NO: 925 - RNA, 20 nt, Artificial Sequence
  spacer sequence
cgaccuugugauccgccugc

SEQ ID NO: 926 - RNA, 20 nt, Artificial Sequence
  spacer sequence
ggaguucgagaccagccugg

SEQ ID NO: 927 - RNA, 20 nt, Artificial Sequence
  spacer sequence
caaggucgggaguucgagac

SEQ ID NO: 928 - RNA, 20 nt, Artificial Sequence
  spacer sequence
gccugccucagccucccaaa

SEQ ID NO: 929 - RNA, 20 nt, Artificial Sequence
  spacer sequence
gccucccaaagugcugggau

SEQ ID NO: 930 - RNA, 20 nt, Artificial Sequence
  spacer sequence
caaagugcugggauuacagg

SEQ ID NO: 931 - RNA, 20 nt, Artificial Sequence
  spacer sequence
cagcacuuugggaggcugag

SEQ ID NO: 932 - RNA, 20 nt, Artificial Sequence
  spacer sequence
ugccuguaaucccagcacuu

SEQ ID NO: 933 - RNA, 20 nt, Artificial Sequence
  spacer sequence
uaaauuuuccuggcgcgcaa

SEQ ID NO: 934 - RNA, 20 nt, Artificial Sequence
  spacer sequence
guguccuaaauuuuccuggc

SEQ ID NO: 935 - RNA, 20 nt, Artificial Sequence
  spacer sequence
uugugugugucuguguccua

SEQ ID NO: 936 - RNA, 20 nt, Artificial Sequence
  spacer sequence
uaaacuccuugugugugucu

SEQ ID NO: 937 - RNA, 20 nt, Artificial Sequence
  spacer sequence
gcuccuaaacuccuugugug

SEQ ID NO: 938 - RNA, 20 nt, Artificial Sequence
  spacer sequence
accuauuaaaccuccgcucc

SEQ ID NO: 939 - RNA, 20 nt, Artificial Sequence
  spacer sequence
ucuaccuauuaaaccuccgc

SEQ ID NO: 940 - RNA, 20 nt, Artificial Sequence
  spacer sequence
cuucuaccuauuaaaccucc

SEQ ID NO: 941 - RNA, 20 nt, Artificial Sequence
  spacer sequence
ucucuucuaccuauuaaacc

SEQ ID NO: 942 - RNA, 20 nt, Artificial Sequence
  spacer sequence
uuuucuucucuucuaccuau

SEQ ID NO: 943 - RNA, 20 nt, Artificial Sequence
  spacer sequence
cuuuuucuucucuucuaccu

SEQ ID NO: 944 - RNA, 20 nt, Artificial Sequence
  spacer sequence
cuccauagaggaaagggccu

SEQ ID NO: 945 - RNA, 20 nt, Artificial Sequence
  spacer sequence
auagaggaaagggccucuga

SEQ ID NO: 946 - RNA, 20 nt, Artificial Sequence
  spacer sequence
auggagggagcuguuucucu

SEQ ID NO: 947 - RNA, 20 nt, Artificial Sequence
  spacer sequence
ucuauggagggagcuguuuc

SEQ ID NO: 948 - RNA, 20 nt, Artificial Sequence
  spacer sequence
gagcagaaaggacugagcag

SEQ ID NO: 949 - RNA, 20 nt, Artificial Sequence
  spacer sequence
gaggcccuuuccucuaugga

SEQ ID NO: 950 - RNA, 20 nt, Artificial Sequence
  spacer sequence
gcucagaggcccuuuccucu

SEQ ID NO: 951 - RNA, 20 nt, Artificial Sequence
  spacer sequence
uuucugcucagaggcccuuu

SEQ ID NO: 952 - RNA, 20 nt, Artificial Sequence
  spacer sequence
guccuuucugcucagaggcc

SEQ ID NO: 953 - RNA, 20 nt, Artificial Sequence
  spacer sequence
ccauauuaauaccccauaua

SEQ ID NO: 954 - RNA, 20 nt, Artificial Sequence
  spacer sequence
auauuaauaccccauauaac

SEQ ID NO: 955 - RNA, 20 nt, Artificial Sequence
  spacer sequence
agcauuuugcaaaauggguu

SEQ ID NO: 956 - RNA, 20 nt, Artificial Sequence
  spacer sequence
auggucuugaggucccugga

SEQ ID NO: 957 - RNA, 20 nt, Artificial Sequence
  spacer sequence
acuucaagcauuuugcaaaa

SEQ ID NO: 958 - RNA, 20 nt, Artificial Sequence
  spacer sequence
ugaggucccuggagcuagaa

SEQ ID NO: 959 - RNA, 20 nt, Artificial Sequence
  spacer sequence
agaccaucgacuucaagcau

SEQ ID NO: 960 - RNA, 20 nt, Artificial Sequence
  spacer sequence
cuggagcuagaaaaggcauu

SEQ ID NO: 961 - RNA, 20 nt, Artificial Sequence
  spacer sequence
agggaccucaagaccaucga

SEQ ID NO: 962 - RNA, 20 nt, Artificial Sequence
  spacer sequence
caaaucugcucuucuuggcc

SEQ ID NO: 963 - RNA, 20 nt, Artificial Sequence
  spacer sequence
gcucuucuuggccuugauga

SEQ ID NO: 964 - RNA, 20 nt, Artificial Sequence
  spacer sequence
ucuuggccuugaugaugaca

SEQ ID NO: 965 - RNA, 20 nt, Artificial Sequence
  spacer sequence
uggccuugaugaugacagug

SEQ ID NO: 966 - RNA, 20 nt, Artificial Sequence
  spacer sequence
aggccaagaagagcagauuu

SEQ ID NO: 967 - RNA, 20 nt, Artificial Sequence
  spacer sequence
ucaaggccaagaagagcaga

SEQ ID NO: 968 - RNA, 20 nt, Artificial Sequence
  spacer sequence
ucaucaaggccaagaagagc

SEQ ID NO: 969 - RNA, 20 nt, Artificial Sequence
  spacer sequence
cuuucuuccagauuugauga

SEQ ID NO: 970 - RNA, 20 nt, Artificial Sequence
  spacer sequence
uucuuccagauuugaugagu

SEQ ID NO: 971 - RNA, 20 nt, Artificial Sequence
  spacer sequence
uccagauuugaugagugugg

SEQ ID NO: 972 - RNA, 20 nt, Artificial Sequence
  spacer sequence
agauuugaugaguguggggc

SEQ ID NO: 973 - RNA, 20 nt, Artificial Sequence
  spacer sequence
ggaagaaagagaccacuguc

SEQ ID NO: 974 - RNA, 20 nt, Artificial Sequence
  spacer sequence
aaucuggaagaaagagacca

SEQ ID NO: 975 - RNA, 20 nt, Artificial Sequence
  spacer sequence
ucaaaucuggaagaaagaga

SEQ ID NO: 976 - RNA, 20 nt, Artificial Sequence
  spacer sequence
aaacccccuuacaaauuuuc

SEQ ID NO: 977 - RNA, 20 nt, Artificial Sequence
  spacer sequence
uacauaugguaucaaaaccc

SEQ ID NO: 978 - RNA, 20 nt, Artificial Sequence
  spacer sequence
uguccuacauaugguaucaa

SEQ ID NO: 979 - RNA, 20 nt, Artificial Sequence
  spacer sequence
auaaacauuguauuuauucc

SEQ ID NO: 980 - RNA, 20 nt, Artificial Sequence
  spacer sequence
ugcaucucagaucauuguau

SEQ ID NO: 981 - RNA, 20 nt, Artificial Sequence
  spacer sequence
cagaucauuguauucaauuc

SEQ ID NO: 982 - RNA, 20 nt, Artificial Sequence
  spacer sequence
gaucauuguauucaauucaa

SEQ ID NO: 983 - RNA, 20 nt, Artificial Sequence
  spacer sequence
gagaugcaagaguucuauaa

SEQ ID NO: 984 - RNA, 20 nt, Artificial Sequence
  spacer sequence
uuguauucaauucaaagugu

SEQ ID NO: 985 - RNA, 20 nt, Artificial Sequence
  spacer sequence
auucaaaguguguaauuuua

SEQ ID NO: 986 - RNA, 20 nt, Artificial Sequence
  spacer sequence
gugcaacaaagauagagaug

SEQ ID NO: 987 - RNA, 20 nt, Artificial Sequence
  spacer sequence
cuacauccccucucugccuu

SEQ ID NO: 988 - RNA, 20 nt, Artificial Sequence
  spacer sequence
ccucucugccuuuguuuucu

SEQ ID NO: 989 - RNA, 20 nt, Artificial Sequence
  spacer sequence
cugccuuuguuuucucaucu

SEQ ID NO: 990 - RNA, 20 nt, Artificial Sequence
  spacer sequence
gccuuuguuuucucaucugu

SEQ ID NO: 991 - RNA, 20 nt, Artificial Sequence
  spacer sequence
caucuguaaagugggaauaa

SEQ ID NO: 992 - RNA, 20 nt, Artificial Sequence
  spacer sequence
ucuguaaagugggaauaaua

SEQ ID NO: 993 - RNA, 20 nt, Artificial Sequence
  spacer sequence
guaaagugggaauaauaaua

SEQ ID NO: 994 - RNA, 20 nt, Artificial Sequence
  spacer sequence
cacuuuacagaugagaaaac

SEQ ID NO: 995 - RNA, 20 nt, Artificial Sequence
  spacer sequence
cuaaguauuuauuuuuauuu

SEQ ID NO: 996 - RNA, 20 nt, Artificial Sequence
  spacer sequence
cacuaaguauuuauuuuuau

SEQ ID NO: 997 - RNA, 20 nt, Artificial Sequence
  spacer sequence
cccucacuggucacuuugcu

SEQ ID NO: 998 - RNA, 20 nt, Artificial Sequence
  spacer sequence
cucacuggucacuuugcuug

SEQ ID NO: 999 - RNA, 20 nt, Artificial Sequence
  spacer sequence
cuggucacuuugcuuggggg

SEQ ID NO: 1000 - RNA, 20 nt, Artificial Sequence
  spacer sequence
cuuugcuuggggguucaaau

SEQ ID NO: 1001 - RNA, 20 nt, Artificial Sequence
  spacer sequence
aauuauaacccaaagcuaug

SEQ ID NO: 1002 - RNA, 20 nt, Artificial Sequence
  spacer sequence
auagcuuuggguuauaauuu

SEQ ID NO: 1003 - RNA, 20 nt, Artificial Sequence
  spacer sequence
caaguaagcauauuccauag

SEQ ID NO: 1004 - RNA, 20 nt, Artificial Sequence
  spacer sequence
cccaaguaagcauauuccau

SEQ ID NO: 1005 - RNA, 20 nt, Artificial Sequence
  spacer sequence
uacagcuccuauacaugaau

SEQ ID NO: 1006 - RNA, 20 nt, Artificial Sequence
  spacer sequence
uauacaugaaucuuuuugaa

SEQ ID NO: 1007 - RNA, 20 nt, Artificial Sequence
  spacer sequence
uguauaggagcuguaagaau

SEQ ID NO: 1008 - RNA, 20 nt, Artificial Sequence
  spacer sequence
uuuugaaacauaucaagggu

SEQ ID NO: 1009 - RNA, 20 nt, Artificial Sequence
  spacer sequence
aaaagauucauguauaggag

SEQ ID NO: 1010 - RNA, 20 nt, Artificial Sequence
  spacer sequence
aggguccuuagaaaucugau

SEQ ID NO: 1011 - RNA, 20 nt, Artificial Sequence
  spacer sequence
uuagaaaucugaucuggugu

SEQ ID NO: 1012 - RNA, 20 nt, Artificial Sequence
  spacer sequence
aaggacccuugauauguuuc

SEQ ID NO: 1013 - RNA, 20 nt, Artificial Sequence
  spacer sequence
gaucuggugugacucucaga

SEQ ID NO: 1014 - RNA, 20 nt, Artificial Sequence
  spacer sequence
gauuucuaaggacccuugau

SEQ ID NO: 1015 - RNA, 20 nt, Artificial Sequence
  spacer sequence
ggugugacucucagagcacu

SEQ ID NO: 1016 - RNA, 20 nt, Artificial Sequence
  spacer sequence
caccagaucagauuucuaag

SEQ ID NO: 1017 - RNA, 20 nt, Artificial Sequence
  spacer sequence
cagagcacucugaugacacc

SEQ ID NO: 1018 - RNA, 20 nt, Artificial Sequence
  spacer sequence
gagcacucugaugacaccug

SEQ ID NO: 1019 - RNA, 20 nt, Artificial Sequence
  spacer sequence
gagagucacaccagaucaga

SEQ ID NO: 1020 - RNA, 20 nt, Artificial Sequence
  spacer sequence
gaugacaccugcuggcuagg

SEQ ID NO: 1021 - RNA, 20 nt, Artificial Sequence
  spacer sequence
gagugcucugagagucacac

SEQ ID NO: 1022 - RNA, 20 nt, Artificial Sequence
  spacer sequence
ucagagugcucugagaguca

SEQ ID NO: 1023 - RNA, 20 nt, Artificial Sequence
  spacer sequence
caccaugccuagccagcagg

SEQ ID NO: 1024 - RNA, 20 nt, Artificial Sequence
  spacer sequence
agucuggacagacggagaug

SEQ ID NO: 1025 - RNA, 20 nt, Artificial Sequence
  spacer sequence
ggacagacggagauggucug

SEQ ID NO: 1026 - RNA, 20 nt, Artificial Sequence
  spacer sequence
agacuagaacacacuuguca

SEQ ID NO: 1027 - RNA, 20 nt, Artificial Sequence
  spacer sequence
guccagacuagaacacacuu

SEQ ID NO: 1028 - RNA, 20 nt, Artificial Sequence
  spacer sequence
gucuguccagacuagaacac

SEQ ID NO: 1029 - RNA, 20 nt, Artificial Sequence
  spacer sequence
ccgucuguccagacuagaac

SEQ ID NO: 1030 - RNA, 20 nt, Artificial Sequence
  spacer sequence
ggaaccccugaguggaguac

SEQ ID NO: 1031 - RNA, 20 nt, Artificial Sequence
  spacer sequence
agaccaucuccgucugucca

SEQ ID NO: 1032 - RNA, 20 nt, Artificial Sequence
  spacer sequence
gggguuccagaccaucuccg

SEQ ID NO: 1033 - RNA, 20 nt, Artificial Sequence
  spacer sequence
acucagggguuccagaccau

SEQ ID NO: 1034 - RNA, 20 nt, Artificial Sequence
  spacer sequence
cagguacuccacucaggggu

SEQ ID NO: 1035 - RNA, 20 nt, Artificial Sequence
  spacer sequence
gcuucccagguacuccacuc

SEQ ID NO: 1036 - RNA, 20 nt, Artificial Sequence
  spacer sequence
agccucagcuucccagguac

SEQ ID NO: 1037 - RNA, 20 nt, Artificial Sequence
  spacer sequence
ccagccucagcuucccaggu

SEQ ID NO: 1038 - RNA, 20 nt, Artificial Sequence
  spacer sequence
cuccagccucagcuucccag

SEQ ID NO: 1039 - RNA, 20 nt, Artificial Sequence
  spacer sequence
ugaccuucaaucuugcugug

SEQ ID NO: 1040 - RNA, 20 nt, Artificial Sequence
  spacer sequence
ggauuucucuccagccucag

SEQ ID NO: 1041 - RNA, 20 nt, Artificial Sequence
  spacer sequence
aucuugcugugcaaagugug

SEQ ID NO: 1042 - RNA, 20 nt, Artificial Sequence
  spacer sequence
ugcugugcaaaguguggucc

SEQ ID NO: 1043 - RNA, 20 nt, Artificial Sequence
  spacer sequence
uagggccugcaguaucggga

SEQ ID NO: 1044 - RNA, 20 nt, Artificial Sequence
  spacer sequence
ggaucacuaggagcuuguaa

SEQ ID NO: 1045 - RNA, 20 nt, Artificial Sequence
  spacer sequence
cgauacugcaggcccuagga

SEQ ID NO: 1046 - RNA, 20 nt, Artificial Sequence
  spacer sequence
cuaggagcuuguaaaugugg

SEQ ID NO: 1047 - RNA, 20 nt, Artificial Sequence
  spacer sequence
uagugaucccgauacugcag

SEQ ID NO: 1048 - RNA, 20 nt, Artificial Sequence
  spacer sequence
cacauuuacaagcuccuagu

SEQ ID NO: 1049 - RNA, 20 nt, Artificial Sequence
  spacer sequence
gacucuacauuuuuuuuuuu

SEQ ID NO: 1050 - RNA, 20 nt, Artificial Sequence
  spacer sequence
gaucccacauuuacaagcuc

SEQ ID NO: 1051 - RNA, 20 nt, Artificial Sequence
  spacer sequence
acauuuuuuuuuuuagagac

SEQ ID NO: 1052 - RNA, 20 nt, Artificial Sequence
  spacer sequence
aaaaaaaaaaauguagaguc

SEQ ID NO: 1053 - RNA, 20 nt, Artificial Sequence
  spacer sequence
cuaaaaaaaaaaauguagag

SEQ ID NO: 1054 - RNA, 20 nt, Artificial Sequence
  spacer sequence
ugcuguguuacccaggcugg

SEQ ID NO: 1055 - RNA, 20 nt, Artificial Sequence
  spacer sequence
caaacuccuaagcucaagca

SEQ ID NO: 1056 - RNA, 20 nt, Artificial Sequence
  spacer sequence
aacuccuaagcucaagcaau

SEQ ID NO: 1057 - RNA, 20 nt, Artificial Sequence
  spacer sequence
uaagcucaagcaauccuccu

SEQ ID NO: 1058 - RNA, 20 nt, Artificial Sequence
  spacer sequence
agcaauccuccugccucagc

SEQ ID NO: 1059 - RNA, 20 nt, Artificial Sequence
  spacer sequence
acaaaaaauacaaaaauuag

SEQ ID NO: 1060 - RNA, 20 nt, Artificial Sequence
  spacer sequence
cuacaaaaaauacaaaaauu

SEQ ID NO: 1061 - RNA, 20 nt, Artificial Sequence
  spacer sequence
ccauguuacccagacugguc

SEQ ID NO: 1062 - RNA, 20 nt, Artificial Sequence
  spacer sequence
ggguaacauggugaaaccuu

SEQ ID NO: 1063 - RNA, 20 nt, Artificial Sequence
  spacer sequence
ugaacuccugagcucaagca

SEQ ID NO: 1064 - RNA, 20 nt, Artificial Sequence
  spacer sequence
agaccagucuggguaacaug

SEQ ID NO: 1065 - RNA, 20 nt, Artificial Sequence
  spacer sequence
ugagcucaagcaauccaccc

SEQ ID NO: 1066 - RNA, 20 nt, Artificial Sequence
  spacer sequence
ggaguucaagaccagucugg

SEQ ID NO: 1067 - RNA, 20 nt, Artificial Sequence
  spacer sequence
agcaauccacccacaucagc

SEQ ID NO: 1068 - RNA, 20 nt, Artificial Sequence
  spacer sequence
acccacaucagccuccugaa

SEQ ID NO: 1069 - RNA, 20 nt, Artificial Sequence
  spacer sequence
gccuccugaagugcugggau

SEQ ID NO: 1070 - RNA, 20 nt, Artificial Sequence
  spacer sequence
ugaagugcugggauuacagg

SEQ ID NO: 1071 - RNA, 20 nt, Artificial Sequence
  spacer sequence
ggaggcugauguggguggau

SEQ ID NO: 1072 - RNA, 20 nt, Artificial Sequence
  spacer sequence
cagcacuucaggaggcugau

SEQ ID NO: 1073 - RNA, 20 nt, Artificial Sequence
  spacer sequence
ugccuguaaucccagcacuu

SEQ ID NO: 1074 - RNA, 20 nt, Artificial Sequence
  spacer sequence
gccaggcacaauggcucaug

SEQ ID NO: 1075 - RNA, 20 nt, Artificial Sequence
  spacer sequence
acauagggcuagcaacucac

SEQ ID NO: 1076 - RNA, 20 nt, Artificial Sequence
  spacer sequence
uauuuucauuuuuauccugu

SEQ ID NO: 1077 - RNA, 20 nt, Artificial Sequence
  spacer sequence
uuuuuauccuguuuucuacu

SEQ ID NO: 1078 - RNA, 20 nt, Artificial Sequence
  spacer sequence
uguuuucuacuuauucuguu

SEQ ID NO: 1079 - RNA, 20 nt, Artificial Sequence
  spacer sequence
acuuauucuguugaagacau

SEQ ID NO: 1080 - RNA, 20 nt, Artificial Sequence
  spacer sequence
guugaagacauuuuuccucc

SEQ ID NO: 1081 - RNA, 20 nt, Artificial Sequence
  spacer sequence
acagaauaaguagaaaacag

SEQ ID NO: 1082 - RNA, 20 nt, Artificial Sequence
  spacer sequence
ucaacagaauaaguagaaaa

SEQ ID NO: 1083 - RNA, 20 nt, Artificial Sequence
  spacer sequence
cagcuacucaggaggcugag

SEQ ID NO: 1084 - RNA, 20 nt, Artificial Sequence
  spacer sequence
ggaggcugaggcaagagaau

SEQ ID NO: 1085 - RNA, 20 nt, Artificial Sequence
  spacer sequence
ugaguagcugggacuacagg

SEQ ID NO: 1086 - RNA, 20 nt, Artificial Sequence
  spacer sequence
gccuccugaguagcugggac

SEQ ID NO: 1087 - RNA, 20 nt, Artificial Sequence
  spacer sequence
ugccucagccuccugaguag

SEQ ID NO: 1088 - RNA, 20 nt, Artificial Sequence
  spacer sequence
cuugccucagccuccugagu

SEQ ID NO: 1089 - RNA, 20 nt, Artificial Sequence
  spacer sequence
cuugaacccgggaggcggag

SEQ ID NO: 1090 - RNA, 20 nt, Artificial Sequence
  spacer sequence
agugauucucuugccucagc

SEQ ID NO: 1091 - RNA, 20 nt, Artificial Sequence
  spacer sequence
cggguucaagugauucucuu

SEQ ID NO: 1092 - RNA, 20 nt, Artificial Sequence
  spacer sequence
gccucccggguucaagugau

SEQ ID NO: 1093 - RNA, 20 nt, Artificial Sequence
  spacer sequence
cugcaaccuccgccucccgg

SEQ ID NO: 1094 - RNA, 20 nt, Artificial Sequence
  spacer sequence
gcucacugcaaccuccgccu

SEQ ID NO: 1095 - RNA, 20 nt, Artificial Sequence
  spacer sequence
ugucugggccacagagcgag

SEQ ID NO: 1096 - RNA, 20 nt, Artificial Sequence
  spacer sequence
gggccacagagcgagaaucc

SEQ ID NO: 1097 - RNA, 20 nt, Artificial Sequence
  spacer sequence
uuuuuuuuuuaaauagauuu

SEQ ID NO: 1098 - RNA, 20 nt, Artificial Sequence
  spacer sequence
uucuuuuuuuuuuuaaauag

SEQ ID NO: 1099 - RNA, 20 nt, Artificial Sequence
  spacer sequence
uuuucuuucuuuuuuuuuuu

SEQ ID NO: 1100 - RNA, 20 nt, Artificial Sequence
  spacer sequence
auuuucuuuuucuuucuuuu

SEQ ID NO: 1101 - RNA, 20 nt, Artificial Sequence
  spacer sequence
agcugaaaagaagaaaaggu

SEQ ID NO: 1102 - RNA, 20 nt, Artificial Sequence
  spacer sequence
gcuugaaaacaucaauuuuc

SEQ ID NO: 1103 - RNA, 20 nt, Artificial Sequence
  spacer sequence
uuucagcuugaaaacaucaa

SEQ ID NO: 1104 - RNA, 20 nt, Artificial Sequence
  spacer sequence
ucuuuucagcuugaaaacau

SEQ ID NO: 1105 - RNA, 20 nt, Artificial Sequence
  spacer sequence
ccugccuauuaaccuuuucu

SEQ ID NO: 1106 - RNA, 20 nt, Artificial Sequence
  spacer sequence
ucggaauaaaacagaaauua

SEQ ID NO: 1107 - RNA, 20 nt, Artificial Sequence
  spacer sequence
gaauaaaacagaaauuaaac

SEQ ID NO: 1108 - RNA, 20 nt, Artificial Sequence
  spacer sequence
gaugacgugguagaaaguug

SEQ ID NO: 1109 - RNA, 20 nt, Artificial Sequence
  spacer sequence
guuuuauuccgaugacgugg

SEQ ID NO: 1110 - RNA, 20 nt, Artificial Sequence
  spacer sequence
acuguuuaauuucuguuuua

SEQ ID NO: 1111 - RNA, 20 nt, Artificial Sequence
  spacer sequence
acucccccaagaccucuggu

SEQ ID NO: 1112 - RNA, 20 nt, Artificial Sequence
  spacer sequence
cccaagaccucuggugucca

SEQ ID NO: 1113 - RNA, 20 nt, Artificial Sequence
  spacer sequence
ugggggaguagaggcccuuu

SEQ ID NO: 1114 - RNA, 20 nt, Artificial Sequence
  spacer sequence
gguguccacccccaucuaau

SEQ ID NO: 1115 - RNA, 20 nt, Artificial Sequence
  spacer sequence
acccccaucuaauauucuua

SEQ ID NO: 1116 - RNA, 20 nt, Artificial Sequence
  spacer sequence
ucuuauguaaaaaagaaaua

SEQ ID NO: 1117 - RNA, 20 nt, Artificial Sequence
  spacer sequence
uucuucuuauguaaaaaaga

SEQ ID NO: 1118 - RNA, 20 nt, Artificial Sequence
  spacer sequence
uagcuaugcagucuuucuuc

SEQ ID NO: 1119 - RNA, 20 nt, Artificial Sequence
  spacer sequence
gucaccagagccacgcaaga

SEQ ID NO: 1120 - RNA, 20 nt, Artificial Sequence
  spacer sequence
ccagagccacgcaagagauc

SEQ ID NO: 1121 - RNA, 20 nt, Artificial Sequence
  spacer sequence
ggugacagaguguauuuuuc

SEQ ID NO: 1122 - RNA, 20 nt, Artificial Sequence
  spacer sequence
ugcguggcucuggugacaga

SEQ ID NO: 1123 - RNA, 20 nt, Artificial Sequence
  spacer sequence
cuugcguggcucuggugaca

SEQ ID NO: 1124 - RNA, 20 nt, Artificial Sequence
  spacer sequence
uuagaggaauaaauagccgc

SEQ ID NO: 1125 - RNA, 20 nt, Artificial Sequence
  spacer sequence
aaagaucucuugcguggcuc

SEQ ID NO: 1126 - RNA, 20 nt, Artificial Sequence
  spacer sequence
ucuaaagaucucuugcgugg

SEQ ID NO: 1127 - RNA, 20 nt, Artificial Sequence
  spacer sequence
cauagcaacauucagaugaa

SEQ ID NO: 1128 - RNA, 20 nt, Artificial Sequence
  spacer sequence
uagcaacauucagaugaaca

SEQ ID NO: 1129 - RNA, 20 nt, Artificial Sequence
  spacer sequence
gaugaacaaugcugagagcu

SEQ ID NO: 1130 - RNA, 20 nt, Artificial Sequence
  spacer sequence
gaauguugcuaugagacugc

SEQ ID NO: 1131 - RNA, 20 nt, Artificial Sequence
  spacer sequence
ucugaauguugcuaugagac

SEQ ID NO: 1132 - RNA, 20 nt, Artificial Sequence
  spacer sequence
gcauuguucaucugaauguu

SEQ ID NO: 1133 - RNA, 20 nt, Artificial Sequence
  spacer sequence
cagcauuguucaucugaaug

SEQ ID NO: 1134 - RNA, 20 nt, Artificial Sequence
  spacer sequence
gcucucagcauuguucaucu

SEQ ID NO: 1135 - RNA, 20 nt, Artificial Sequence
  spacer sequence
uucagcucucagcauuguuc

SEQ ID NO: 1136 - RNA, 20 nt, Artificial Sequence
  spacer sequence
ucgguuagaaauucaugccu

SEQ ID NO: 1137 - RNA, 20 nt, Artificial Sequence
  spacer sequence
guuagaaauucaugccuaca

SEQ ID NO: 1138 - RNA, 20 nt, Artificial Sequence
  spacer sequence
aaccgaagaacaucuuucag

SEQ ID NO: 1139 - RNA, 20 nt, Artificial Sequence
  spacer sequence
ugccuacaaaagaauaccau

SEQ ID NO: 1140 - RNA, 20 nt, Artificial Sequence
  spacer sequence
uuuagguuccccaucucugg

SEQ ID NO: 1141 - RNA, 20 nt, Artificial Sequence
  spacer sequence
ccaucucuggcccauggacu

SEQ ID NO: 1142 - RNA, 20 nt, Artificial Sequence
  spacer sequence
cuggcccauggacuuugggg

SEQ ID NO: 1143 - RNA, 20 nt, Artificial Sequence
  spacer sequence
ggcccauggacuuuggggga

SEQ ID NO: 1144 - RNA, 20 nt, Artificial Sequence
  spacer sequence
augggccagagauggggaac

SEQ ID NO: 1145 - RNA, 20 nt, Artificial Sequence
  spacer sequence
cccaaaguccaugggccaga

SEQ ID NO: 1146 - RNA, 20 nt, Artificial Sequence
  spacer sequence
aggaaauaaguccuuuaauu

SEQ ID NO: 1147 - RNA, 20 nt, Artificial Sequence
  spacer sequence
uggaccugcucccccaaagu

SEQ ID NO: 1148 - RNA, 20 nt, Artificial Sequence
  spacer sequence
uuuaauuggaagccagaagu

SEQ ID NO: 1149 - RNA, 20 nt, Artificial Sequence
  spacer sequence
aauuaaaggacuuauuuccu

SEQ ID NO: 1150 - RNA, 20 nt, Artificial Sequence
  spacer sequence
ggaccuuggagagaucaacg

SEQ ID NO: 1151 - RNA, 20 nt, Artificial Sequence
  spacer sequence
ugauaagccaucgucucagc

SEQ ID NO: 1152 - RNA, 20 nt, Artificial Sequence
  spacer sequence
aagguccugauaagccaucg

SEQ ID NO: 1153 - RNA, 20 nt, Artificial Sequence
  spacer sequence
ccaagguccugauaagccau

SEQ ID NO: 1154 - RNA, 20 nt, Artificial Sequence
  spacer sequence
cuccaagguccugauaagcc

SEQ ID NO: 1155 - RNA, 20 nt, Artificial Sequence
  spacer sequence
acgcuauccugagagauuga

SEQ ID NO: 1156 - RNA, 20 nt, Artificial Sequence
  spacer sequence
ugagagauugaauuaaggua

SEQ ID NO: 1157 - RNA, 20 nt, Artificial Sequence
  spacer sequence
ggauagcguugaucucucca

SEQ ID NO: 1158 - RNA, 20 nt, Artificial Sequence
  spacer sequence
caggauagcguugaucucuc

SEQ ID NO: 1159 - RNA, 20 nt, Artificial Sequence
  spacer sequence
cucaggauagcguugaucuc

SEQ ID NO: 1160 - RNA, 20 nt, Artificial Sequence
  spacer sequence
aucucucaggauagcguuga

SEQ ID NO: 1161 - RNA, 20 nt, Artificial Sequence
  spacer sequence
uggcaggcauuuaccaauac

SEQ ID NO: 1162 - RNA, 20 nt, Artificial Sequence
  spacer sequence
aucuuggcaggcauuuacca

SEQ ID NO: 1163 - RNA, 20 nt, Artificial Sequence
  spacer sequence
uaauucaaucuuggcaggca

SEQ ID NO: 1164 - RNA, 20 nt, Artificial Sequence
  spacer sequence
agccuaccaagguauuuacc

SEQ ID NO: 1165 - RNA, 20 nt, Artificial Sequence
  spacer sequence
auuguucuagccuaccaagg

SEQ ID NO: 1166 - RNA, 20 nt, Artificial Sequence
  spacer sequence
uccauuguucuagccuacca

SEQ ID NO: 1167 - RNA, 20 nt, Artificial Sequence
  spacer sequence
aacaauugaaauuuaaucgg

SEQ ID NO: 1168 - RNA, 20 nt, Artificial Sequence
  spacer sequence
auuguuagauuucauccauu

SEQ ID NO: 1169 - RNA, 20 nt, Artificial Sequence
  spacer sequence
gaaaaaaaaagaaauuuaau

SEQ ID NO: 1170 - RNA, 20 nt, Artificial Sequence
  spacer sequence
gauuaaauuucaauuguuag

SEQ ID NO: 1171 - RNA, 20 nt, Artificial Sequence
  spacer sequence
uuuuuuuuccgauuaaauuu

SEQ ID NO: 1172 - RNA, 20 nt, Artificial Sequence
  spacer sequence
ggauaaauguacauucuggu

SEQ ID NO: 1173 - RNA, 20 nt, Artificial Sequence
  spacer sequence
ugauuaaauuucuuuuuuuu

SEQ ID NO: 1174 - RNA, 20 nt, Artificial Sequence
  spacer sequence
gguccacagaauaccaagug

SEQ ID NO: 1175 - RNA, 20 nt, Artificial Sequence
  spacer sequence
acagaauaccaagugcauaa

SEQ ID NO: 1176 - RNA, 20 nt, Artificial Sequence
  spacer sequence
guggaccagaauguacauuu

SEQ ID NO: 1177 - RNA, 20 nt, Artificial Sequence
  spacer sequence
guuauuuuuaugcacuuggu

SEQ ID NO: 1178 - RNA, 20 nt, Artificial Sequence
  spacer sequence
ccugccaccacccccagcua

SEQ ID NO: 1179 - RNA, 20 nt, Artificial Sequence
  spacer sequence
ucccagcuacucaggaggcu

SEQ ID NO: 1180 - RNA, 20 nt, Artificial Sequence
  spacer sequence
cagcuacucaggaggcugag

SEQ ID NO: 1181 - RNA, 20 nt, Artificial Sequence
  spacer sequence
ggaggcugaggcaggagaau

SEQ ID NO: 1182 - RNA, 20 nt, Artificial Sequence
  spacer sequence
ugaguagcugggaugacagu

SEQ ID NO: 1183 - RNA, 20 nt, Artificial Sequence
  spacer sequence
gccuccugaguagcugggau

SEQ ID NO: 1184 - RNA, 20 nt, Artificial Sequence
  spacer sequence
ugccucagccuccugaguag

SEQ ID NO: 1185 - RNA, 20 nt, Artificial Sequence
  spacer sequence
ccugccucagccuccugagu

SEQ ID NO: 1186 - RNA, 20 nt, Artificial Sequence
  spacer sequence
agcaauucuccugccucagc

SEQ ID NO: 1187 - RNA, 20 nt, Artificial Sequence
  spacer sequence
uggguucaagcaauucuccu

SEQ ID NO: 1188 - RNA, 20 nt, Artificial Sequence
  spacer sequence
gccuccuggguucaagcaau

SEQ ID NO: 1189 - RNA, 20 nt, Artificial Sequence
  spacer sequence
cugcaaccuccgccuccugg

SEQ ID NO: 1190 - RNA, 20 nt, Artificial Sequence
  spacer sequence
gcucacugcaaccuccgccu

SEQ ID NO: 1191 - RNA, 20 nt, Artificial Sequence
  spacer sequence
cagcucacugcaaccuccgc

SEQ ID NO: 1192 - RNA, 20 nt, Artificial Sequence
  spacer sequence
gacugggugcaguggugcac

SEQ ID NO: 1193 - RNA, 20 nt, Artificial Sequence
  spacer sequence
gaacuuaccauuuucagaca

SEQ ID NO: 1194 - RNA, 20 nt, Artificial Sequence
  spacer sequence
cagcacuuugggaggccaag

SEQ ID NO: 1195 - RNA, 20 nt, Artificial Sequence
  spacer sequence
caaagugcugggauuauaag

SEQ ID NO: 1196 - RNA, 20 nt, Artificial Sequence
  spacer sequence
caccuuggccucccaaagug

SEQ ID NO: 1197 - RNA, 20 nt, Artificial Sequence
  spacer sequence
ucccaccuuggccucccaaa

SEQ ID NO: 1198 - RNA, 20 nt, Artificial Sequence
  spacer sequence
cuugagcucaagaguucaag

SEQ ID NO: 1199 - RNA, 20 nt, Artificial Sequence
  spacer sequence
agugauccucccaccuuggc

SEQ ID NO: 1200 - RNA, 20 nt, Artificial Sequence
  spacer sequence
agaguucaagaccagccugg

SEQ ID NO: 1201 - RNA, 20 nt, Artificial Sequence
  spacer sequence
ugagcucaagugauccuccc

SEQ ID NO: 1202 - RNA, 20 nt, Artificial Sequence
  spacer sequence
agaccagccugggcaguaug

SEQ ID NO: 1203 - RNA, 20 nt, Artificial Sequence
  spacer sequence
ugaacucuugagcucaagug

SEQ ID NO: 1204 - RNA, 20 nt, Artificial Sequence
  spacer sequence
cucaaaaaaaaaaaaaaaaa

SEQ ID NO: 1205 - RNA, 20 nt, Artificial Sequence
  spacer sequence
caaaaaaaaaaaaaaaaaaa

SEQ ID NO: 1206 - RNA, 20 nt, Artificial Sequence
  spacer sequence
aaaaaaaaaaaaaaaaaaaa

SEQ ID NO: 1207 - RNA, 20 nt, Artificial Sequence
  spacer sequence
ccaucagaaccuaaccuucc

SEQ ID NO: 1208 - RNA, 20 nt, Artificial Sequence
  spacer sequence
cuucaccaucagaaccuaac

SEQ ID NO: 1209 - RNA, 20 nt, Artificial Sequence
  spacer sequence
gaugguuacuucaccaagca

SEQ ID NO: 1210 - RNA, 20 nt, Artificial Sequence
  spacer sequence
gaaccuucccuucaccauca

SEQ ID NO: 1211 - RNA, 20 nt, Artificial Sequence
  spacer sequence
ccaagcaagagaagcucugg

SEQ ID NO: 1212 - RNA, 20 nt, Artificial Sequence
  spacer sequence
ugcuuggugaaguaaccauc

SEQ ID NO: 1213 - RNA, 20 nt, Artificial Sequence
  spacer sequence
cuugcuuggugaaguaacca

SEQ ID NO: 1214 - RNA, 20 nt, Artificial Sequence
  spacer sequence
gguugcugaagaaguuccua

SEQ ID NO: 1215 - RNA, 20 nt, Artificial Sequence
  spacer sequence
gcaaccagagcuucucuugc

SEQ ID NO: 1216 - RNA, 20 nt, Artificial Sequence
  spacer sequence
ucagcaaccagagcuucucu

SEQ ID NO: 1217 - RNA, 20 nt, Artificial Sequence
  spacer sequence
uacagagggggauccugcua

SEQ ID NO: 1218 - RNA, 20 nt, Artificial Sequence
  spacer sequence
guaggaacuucuucagcaac

SEQ ID NO: 1219 - RNA, 20 nt, Artificial Sequence
  spacer sequence
cccucuguaggaacuucuuc

SEQ ID NO: 1220 - RNA, 20 nt, Artificial Sequence
  spacer sequence
ugcuauggucugaauguuug

SEQ ID NO: 1221 - RNA, 20 nt, Artificial Sequence
  spacer sequence
gaauguuuguuucccuccca

SEQ ID NO: 1222 - RNA, 20 nt, Artificial Sequence
  spacer sequence
gaccauagcaggaucccccu

SEQ ID NO: 1223 - RNA, 20 nt, Artificial Sequence
  spacer sequence
cucccaaauucauauguuga

SEQ ID NO: 1224 - RNA, 20 nt, Artificial Sequence
  spacer sequence
caaauucauauguugaaauc

SEQ ID NO: 1225 - RNA, 20 nt, Artificial Sequence
  spacer sequence
uauguugaaauccuaacccc

SEQ ID NO: 1226 - RNA, 20 nt, Artificial Sequence
  spacer sequence
acauaugaauuugggaggga

SEQ ID NO: 1227 - RNA, 20 nt, Artificial Sequence
  spacer sequence
uaaccccauggugauggcau

SEQ ID NO: 1228 - RNA, 20 nt, Artificial Sequence
  spacer sequence
ccaugggguuaggauuucaa

SEQ ID NO: 1229 - RNA, 20 nt, Artificial Sequence
  spacer sequence
auuaaauaaugccaucacca

SEQ ID NO: 1230 - RNA, 20 nt, Artificial Sequence
  spacer sequence
ccuuuguuacugaucuuugc

SEQ ID NO: 1231 - RNA, 20 nt, Artificial Sequence
  spacer sequence
guaacaaaggugaugccagu

SEQ ID NO: 1232 - RNA, 20 nt, Artificial Sequence
  spacer sequence
uugcagccaagaauaauuau

SEQ ID NO: 1233 - RNA, 20 nt, Artificial Sequence
  spacer sequence
uggcugcaaagaucaguaac

SEQ ID NO: 1234 - RNA, 20 nt, Artificial Sequence
  spacer sequence
aaacaauuauguaaucuucu

SEQ ID NO: 1235 - RNA, 20 nt, Artificial Sequence
  spacer sequence
ucuucacuuuuuccuuuaaa

SEQ ID NO: 1236 - RNA, 20 nt, Artificial Sequence
  spacer sequence
ucacuuuuuccuuuaaaaac

SEQ ID NO: 1237 - RNA, 20 nt, Artificial Sequence
  spacer sequence
cuuuuuccuuuaaaaaccuu

SEQ ID NO: 1238 - RNA, 20 nt, Artificial Sequence
  spacer sequence
uuuaaaaaccuuuguuuucu

SEQ ID NO: 1239 - RNA, 20 nt, Artificial Sequence
  spacer sequence
uuuaccucccugaauacgua

SEQ ID NO: 1240 - RNA, 20 nt, Artificial Sequence
  spacer sequence
cugaauacguaccuaguuua

SEQ ID NO: 1241 - RNA, 20 nt, Artificial Sequence
  spacer sequence
gggagguaaaagaaaacaaa

SEQ ID NO: 1242 - RNA, 20 nt, Artificial Sequence
  spacer sequence
uggugcaaucuucccaccuc

SEQ ID NO: 1243 - RNA, 20 nt, Artificial Sequence
  spacer sequence
accuccuggugcaaucuucc

SEQ ID NO: 1244 - RNA, 20 nt, Artificial Sequence
  spacer sequence
cuguggccucaaccuccugg

SEQ ID NO: 1245 - RNA, 20 nt, Artificial Sequence
  spacer sequence
ugaucacaccacugcauucc

SEQ ID NO: 1246 - RNA, 20 nt, Artificial Sequence
  spacer sequence
agacucacuguggccucaac

SEQ ID NO: 1247 - RNA, 20 nt, Artificial Sequence
  spacer sequence
caccacugcauuccagcuug

SEQ ID NO: 1248 - RNA, 20 nt, Artificial Sequence
  spacer sequence
agcuugggcagcagaacgag

SEQ ID NO: 1249 - RNA, 20 nt, Artificial Sequence
  spacer sequence
gcugcccaagcuggaaugca

SEQ ID NO: 1250 - RNA, 20 nt, Artificial Sequence
  spacer sequence
uucugcugcccaagcuggaa

SEQ ID NO: 1251 - RNA, 20 nt, Artificial Sequence
  spacer sequence
cguucugcugcccaagcugg

SEQ ID NO: 1252 - RNA, 20 nt, Artificial Sequence
  spacer sequence
cgcucucguucugcugccca

SEQ ID NO: 1253 - RNA, 20 nt, Artificial Sequence
  spacer sequence
auguaaguuacagcgcaaca

SEQ ID NO: 1254 - RNA, 20 nt, Artificial Sequence
  spacer sequence
ugcguguggggaaagaugac

SEQ ID NO: 1255 - RNA, 20 nt, Artificial Sequence
  spacer sequence
ccacacgcaagaguuuuaau

SEQ ID NO: 1256 - RNA, 20 nt, Artificial Sequence
  spacer sequence
uuccccacacgcaagaguuu

SEQ ID NO: 1257 - RNA, 20 nt, Artificial Sequence
  spacer sequence
ucuuuccccacacgcaagag

SEQ ID NO: 1258 - RNA, 20 nt, Artificial Sequence
  spacer sequence
auauggccaacuacaccugc

SEQ ID NO: 1259 - RNA, 20 nt, Artificial Sequence
  spacer sequence
gaugaguuuuguaauucagu

SEQ ID NO: 1260 - RNA, 20 nt, Artificial Sequence
  spacer sequence
gaacacuauuuuccauaugg

SEQ ID NO: 1261 - RNA, 20 nt, Artificial Sequence
  spacer sequence
ucugaacacuauuuuccaua

SEQ ID NO: 1262 - RNA, 20 nt, Artificial Sequence
  spacer sequence
guuggagaauuuggcaagaa

SEQ ID NO: 1263 - RNA, 20 nt, Artificial Sequence
  spacer sequence
aacugaauuacaaaacucau

SEQ ID NO: 1264 - RNA, 20 nt, Artificial Sequence
  spacer sequence
ccaacugaauuacaaaacuc

SEQ ID NO: 1265 - RNA, 20 nt, Artificial Sequence
  spacer sequence
ugccaaauucuccaacugaa

SEQ ID NO: 1266 - RNA, 20 nt, Artificial Sequence
  spacer sequence
aaacuaguauccucaauuuu

SEQ ID NO: 1267 - RNA, 20 nt, Artificial Sequence
  spacer sequence
ucaauuuucuauaucuucuc

SEQ ID NO: 1268 - RNA, 20 nt, Artificial Sequence
  spacer sequence
auuuucuauaucuucucugc

SEQ ID NO: 1269 - RNA, 20 nt, Artificial Sequence
  spacer sequence
auaucuucucugccacauuu

SEQ ID NO: 1270 - RNA, 20 nt, Artificial Sequence
  spacer sequence
ucucugccacauuuggcaga

SEQ ID NO: 1271 - RNA, 20 nt, Artificial Sequence
  spacer sequence
cugccacauuuggcagaaga

SEQ ID NO: 1272 - RNA, 20 nt, Artificial Sequence
  spacer sequence
gccacauuuggcagaagaaa

SEQ ID NO: 1273 - RNA, 20 nt, Artificial Sequence
  spacer sequence
gccaaauguggcagagaaga

SEQ ID NO: 1274 - RNA, 20 nt, Artificial Sequence
  spacer sequence
ucugccaaauguggcagaga

SEQ ID NO: 1275 - RNA, 20 nt, Artificial Sequence
  spacer sequence
uuuucuucugccaaaugugg

SEQ ID NO: 1276 - RNA, 20 nt, Artificial Sequence
  spacer sequence
cuuuuucuucugccaaaugu

SEQ ID NO: 1277 - RNA, 20 nt, Artificial Sequence
  spacer sequence
cucuuuuucuucugccaaau

SEQ ID NO: 1278 - RNA, 20 nt, Artificial Sequence
  spacer sequence
aaguaucucucuuuuucuuc

SEQ ID NO: 1279 - RNA, 20 nt, Artificial Sequence
  spacer sequence
uuucuaaguaucucucuuuu

SEQ ID NO: 1280 - RNA, 20 nt, Artificial Sequence
  spacer sequence
auaucuuuucuaaguaucuc

SEQ ID NO: 1281 - RNA, 20 nt, Artificial Sequence
  spacer sequence
guuuucuauaucuuuucuaa

SEQ ID NO: 1282 - RNA, 20 nt, Artificial Sequence
  spacer sequence
aaacuaguacccucaguuuu

SEQ ID NO: 1283 - RNA, 20 nt, Artificial Sequence
  spacer sequence
guuuuuuaauagcaguuuaa

SEQ ID NO: 1284 - RNA, 20 nt, Artificial Sequence
  spacer sequence
gccugauuuagccagaauaa

SEQ ID NO: 1285 - RNA, 20 nt, Artificial Sequence
  spacer sequence
ggcagauauaacuacacaca

SEQ ID NO: 1286 - RNA, 20 nt, Artificial Sequence
  spacer sequence
ggcuaaaucaggcagauaua

SEQ ID NO: 1287 - RNA, 20 nt, Artificial Sequence
  spacer sequence
gagaggccucccuggaggag

SEQ ID NO: 1288 - RNA, 20 nt, Artificial Sequence
  spacer sequence
gacuuauucuggcuaaauca

SEQ ID NO: 1289 - RNA, 20 nt, Artificial Sequence
  spacer sequence
cugacuuauucuggcuaaau

SEQ ID NO: 1290 - RNA, 20 nt, Artificial Sequence
  spacer sequence
cuggaggaggcagcaucaga

SEQ ID NO: 1291 - RNA, 20 nt, Artificial Sequence
  spacer sequence
agggaggccucucugacuua

SEQ ID NO: 1292 - RNA, 20 nt, Artificial Sequence
  spacer sequence
uccagggaggccucucugac

SEQ ID NO: 1293 - RNA, 20 nt, Artificial Sequence
  spacer sequence
gaguugggacuguagagggu

SEQ ID NO: 1294 - RNA, 20 nt, Artificial Sequence
  spacer sequence
gaugcugccuccuccaggga

SEQ ID NO: 1295 - RNA, 20 nt, Artificial Sequence
  spacer sequence
caacucugaugcugccuccu

SEQ ID NO: 1296 - RNA, 20 nt, Artificial Sequence
  spacer sequence
acagucccaacucugaugcu

SEQ ID NO: 1297 - RNA, 20 nt, Artificial Sequence
  spacer sequence
aguugggggaccucucugag

SEQ ID NO: 1298 - RNA, 20 nt, Artificial Sequence
  spacer sequence
guggagcugggauuagaacu

SEQ ID NO: 1299 - RNA, 20 nt, Artificial Sequence
  spacer sequence
acugauaucuaguuggggga

SEQ ID NO: 1300 - RNA, 20 nt, Artificial Sequence
  spacer sequence
cagcuccacugauaucuagu

SEQ ID NO: 1301 - RNA, 20 nt, Artificial Sequence
  spacer sequence
aaucccagcuccacugauau

SEQ ID NO: 1302 - RNA, 20 nt, Artificial Sequence
  spacer sequence
ccugacuuccaaauuaccuc

SEQ ID NO: 1303 - RNA, 20 nt, Artificial Sequence
  spacer sequence
ugacuuccaaauuaccucau

SEQ ID NO: 1304 - RNA, 20 nt, Artificial Sequence
  spacer sequence
ggagacccaguucuaauccc

SEQ ID NO: 1305 - RNA, 20 nt, Artificial Sequence
  spacer sequence
aaauuaccucauuaaacagg

SEQ ID NO: 1306 - RNA, 20 nt, Artificial Sequence
  spacer sequence
uuaaacagggaugccagguu

SEQ ID NO: 1307 - RNA, 20 nt, Artificial Sequence
  spacer sequence
cuguuuaaugagguaauuug

SEQ ID NO: 1308 - RNA, 20 nt, Artificial Sequence
  spacer sequence
gcauugugggaacuaaacau

SEQ ID NO: 1309 - RNA, 20 nt, Artificial Sequence
  spacer sequence
cacaaugcugaguugagagu

SEQ ID NO: 1310 - RNA, 20 nt, Artificial Sequence
  spacer sequence
caaucagcuucaggagccuc

SEQ ID NO: 1311 - RNA, 20 nt, Artificial Sequence
  spacer sequence
gcuucaggagccucacuguu

SEQ ID NO: 1312 - RNA, 20 nt, Artificial Sequence
  spacer sequence
ggagccucacuguugccaug

SEQ ID NO: 1313 - RNA, 20 nt, Artificial Sequence
  spacer sequence
ugaagcugauugugauguuu

SEQ ID NO: 1314 - RNA, 20 nt, Artificial Sequence
  spacer sequence
cuguugccauggguuacaug

SEQ ID NO: 1315 - RNA, 20 nt, Artificial Sequence
  spacer sequence
uguaacccauggcaacagug

SEQ ID NO: 1316 - RNA, 20 nt, Artificial Sequence
  spacer sequence
aaucuaaggauggaaccaaa

SEQ ID NO: 1317 - RNA, 20 nt, Artificial Sequence
  spacer sequence
aaggauggaaccaaaacagg

SEQ ID NO: 1318 - RNA, 20 nt, Artificial Sequence
  spacer sequence
uuagauuugaauucauguaa

SEQ ID NO: 1319 - RNA, 20 nt, Artificial Sequence
  spacer sequence
auccuuagauuugaauucau

SEQ ID NO: 1320 - RNA, 20 nt, Artificial Sequence
  spacer sequence
gcccucgagugggaggugaa

SEQ ID NO: 1321 - RNA, 20 nt, Artificial Sequence
  spacer sequence
agugggaggugaaaugaagu

SEQ ID NO: 1322 - RNA, 20 nt, Artificial Sequence
  spacer sequence
agggcugauauuuaagggcc

SEQ ID NO: 1323 - RNA, 20 nt, Artificial Sequence
  spacer sequence
cacucgagggcugauauuua

SEQ ID NO: 1324 - RNA, 20 nt, Artificial Sequence
  spacer sequence
ccucccacucgagggcugau

SEQ ID NO: 1325 - RNA, 20 nt, Artificial Sequence
  spacer sequence
uuucaccucccacucgaggg

SEQ ID NO: 1326 - RNA, 20 nt, Artificial Sequence
  spacer sequence
aacaccuuaaaggaaaacag

SEQ ID NO: 1327 - RNA, 20 nt, Artificial Sequence
  spacer sequence
uuuaagguguuagagcacuu

SEQ ID NO: 1328 - RNA, 20 nt, Artificial Sequence
  spacer sequence
uguuuuccuuuaagguguua

SEQ ID NO: 1329 - RNA, 20 nt, Artificial Sequence
  spacer sequence
ccuguuuuccuuuaaggugu

SEQ ID NO: 1330 - RNA, 20 nt, Artificial Sequence
  spacer sequence
ugcuguagcgggacccaccc

SEQ ID NO: 1331 - RNA, 20 nt, Artificial Sequence
  spacer sequence
aggcagcaaccacccauccu

SEQ ID NO: 1332 - RNA, 20 nt, Artificial Sequence
  spacer sequence
auuuguuaacagcugcuaaa

SEQ ID NO: 1333 - RNA, 20 nt, Artificial Sequence
  spacer sequence
aggcuccaggcagcaaccac

SEQ ID NO: 1334 - RNA, 20 nt, Artificial Sequence
  spacer sequence
cuguguauagggcuugcaag

SEQ ID NO: 1335 - RNA, 20 nt, Artificial Sequence
  spacer sequence
guguauagggcuugcaaguc

SEQ ID NO: 1336 - RNA, 20 nt, Artificial Sequence
  spacer sequence
uggcggauacccagagaaau

SEQ ID NO: 1337 - RNA, 20 nt, Artificial Sequence
  spacer sequence
gccaagacuugcaagcccua

SEQ ID NO: 1338 - RNA, 20 nt, Artificial Sequence
  spacer sequence
ggguauccgccaagacuugc

SEQ ID NO: 1339 - RNA, 20 nt, Artificial Sequence
  spacer sequence
cuggguauccgccaagacuu

SEQ ID NO: 1340 - RNA, 20 nt, Artificial Sequence
  spacer sequence
uauuucucuggguauccgcc

SEQ ID NO: 1341 - RNA, 20 nt, Artificial Sequence
  spacer sequence
uucuuauuucucuggguauc

SEQ ID NO: 1342 - RNA, 20 nt, Artificial Sequence
  spacer sequence
gaaacuagaccugcgccguc

SEQ ID NO: 1343 - RNA, 20 nt, Artificial Sequence
  spacer sequence
gacauucguucuuauuucuc

SEQ ID NO: 1344 - RNA, 20 nt, Artificial Sequence
  spacer sequence
gugcuaauaacaauaccuac

SEQ ID NO: 1345 - RNA, 20 nt, Artificial Sequence
  spacer sequence
cugugcuaauaacaauaccu

SEQ ID NO: 1346 - RNA, 20 nt, Artificial Sequence
  spacer sequence
accucucugugcuaauaaca

SEQ ID NO: 1347 - RNA, 20 nt, Artificial Sequence
  spacer sequence
cacagcuaguaaauagaaaa

SEQ ID NO: 1348 - RNA, 20 nt, Artificial Sequence
  spacer sequence
auuuacuagcugugugacuu

SEQ ID NO: 1349 - RNA, 20 nt, Artificial Sequence
  spacer sequence
uaguuuuucuauuuacuagc

SEQ ID NO: 1350 - RNA, 20 nt, Artificial Sequence
  spacer sequence
aaccccaggaagucugucuc

SEQ ID NO: 1351 - RNA, 20 nt, Artificial Sequence
  spacer sequence
guguguguuggagcaggaga

SEQ ID NO: 1352 - RNA, 20 nt, Artificial Sequence
  spacer sequence
ucaguguguguuggagcagg

SEQ ID NO: 1353 - RNA, 20 nt, Artificial Sequence
  spacer sequence
gcacacggcaagccaggagg

SEQ ID NO: 1354 - RNA, 20 nt, Artificial Sequence
  spacer sequence
uggcuugccgugugcugaug

SEQ ID NO: 1355 - RNA, 20 nt, Artificial Sequence
  spacer sequence
uccuggcuugccgugugcug

SEQ ID NO: 1356 - RNA, 20 nt, Artificial Sequence
  spacer sequence
ggugggggcacuccuccugg

SEQ ID NO: 1357 - RNA, 20 nt, Artificial Sequence
  spacer sequence
gguucuggugggggcacucc

SEQ ID NO: 1358 - RNA, 20 nt, Artificial Sequence
  spacer sequence
gggugccagcauggucaggu

SEQ ID NO: 1359 - RNA, 20 nt, Artificial Sequence
  spacer sequence
cagacuuccagccuccagaa

SEQ ID NO: 1360 - RNA, 20 nt, Artificial Sequence
  spacer sequence
gcgaucagggugccagcaug

SEQ ID NO: 1361 - RNA, 20 nt, Artificial Sequence
  spacer sequence
agccuccagaacugugacaa

SEQ ID NO: 1362 - RNA, 20 nt, Artificial Sequence
  spacer sequence
aguggcagaggacaaaggaa

SEQ ID NO: 1363 - RNA, 20 nt, Artificial Sequence
  spacer sequence
gccacuugaagucucuauaa

SEQ ID NO: 1364 - RNA, 20 nt, Artificial Sequence
  spacer sequence
ucugccacuugaagucucua

SEQ ID NO: 1365 - RNA, 20 nt, Artificial Sequence
  spacer sequence
uuuguccucugccacuugaa

SEQ ID NO: 1366 - RNA, 20 nt, Artificial Sequence
  spacer sequence
uuccuuuguccucugccacu

SEQ ID NO: 1367 - RNA, 20 nt, Artificial Sequence
  spacer sequence
cggcuaugucauuccuuugu

SEQ ID NO: 1368 - RNA, 20 nt, Artificial Sequence
  spacer sequence
ccucccggcuaugucauucc

SEQ ID NO: 1369 - RNA, 20 nt, Artificial Sequence
  spacer sequence
cuguccccucccggcuaugu

SEQ ID NO: 1370 - RNA, 20 nt, Artificial Sequence
  spacer sequence
gcccagcaucccuguccccu

SEQ ID NO: 1371 - RNA, 20 nt, Artificial Sequence
  spacer sequence
ucagcccagcaucccugucc

SEQ ID NO: 1372 - RNA, 20 nt, Artificial Sequence
  spacer sequence
ucuucagcccagcaucccug

SEQ ID NO: 1373 - RNA, 20 nt, Artificial Sequence
  spacer sequence
cucaucuucagcccagcauc

SEQ ID NO: 1374 - RNA, 20 nt, Artificial Sequence
  spacer sequence
auaugcagcaugcucccucu

SEQ ID NO: 1375 - RNA, 20 nt, Artificial Sequence
  spacer sequence
caacugugcuuuguuuauug

SEQ ID NO: 1376 - RNA, 20 nt, Artificial Sequence
  spacer sequence
gccaauaaacaaagcacagu

SEQ ID NO: 1377 - RNA, 20 nt, Artificial Sequence
  spacer sequence
uuucugccaauaaacaaagc

SEQ ID NO: 1378 - RNA, 20 nt, Artificial Sequence
  spacer sequence
aacuucauuucugccaauaa

SEQ ID NO: 1379 - RNA, 20 nt, Artificial Sequence
  spacer sequence
ccauccccugggcagcagca

SEQ ID NO: 1380 - RNA, 20 nt, Artificial Sequence
  spacer sequence
augccuugcauuugcaguug

SEQ ID NO: 1381 - RNA, 20 nt, Artificial Sequence
  spacer sequence
agguugcacacuccuuauga

SEQ ID NO: 1382 - RNA, 20 nt, Artificial Sequence
  spacer sequence
uuaugagaaccuaaugccug

SEQ ID NO: 1383 - RNA, 20 nt, Artificial Sequence
  spacer sequence
uaaggagugugcaaccuaga

SEQ ID NO: 1384 - RNA, 20 nt, Artificial Sequence
  spacer sequence
cauaaggagugugcaaccua

SEQ ID NO: 1385 - RNA, 20 nt, Artificial Sequence
  spacer sequence
ggcauuagguucucauaagg

SEQ ID NO: 1386 - RNA, 20 nt, Artificial Sequence
  spacer sequence
ucaggcauuagguucucaua

SEQ ID NO: 1387 - RNA, 20 nt, Artificial Sequence
  spacer sequence
gucacugucucccaugaccc

SEQ ID NO: 1388 - RNA, 20 nt, Artificial Sequence
  spacer sequence
cugucucccaugacccccag

SEQ ID NO: 1389 - RNA, 20 nt, Artificial Sequence
  spacer sequence
cccaugacccccagauggga

SEQ ID NO: 1390 - RNA, 20 nt, Artificial Sequence
  spacer sequence
caugacccccagaugggacc

SEQ ID NO: 1391 - RNA, 20 nt, Artificial Sequence
  spacer sequence
ugggagacagugacagauca

SEQ ID NO: 1392 - RNA, 20 nt, Artificial Sequence
  spacer sequence
gggggucaugggagacagug

SEQ ID NO: 1393 - RNA, 20 nt, Artificial Sequence
  spacer sequence
caucugggggucaugggaga

SEQ ID NO: 1394 - RNA, 20 nt, Artificial Sequence
  spacer sequence
ggaagacaagcucagggauc

SEQ ID NO: 1395 - RNA, 20 nt, Artificial Sequence
  spacer sequence
ugaaacuagguggucccauc

SEQ ID NO: 1396 - RNA, 20 nt, Artificial Sequence
  spacer sequence
aaucaucccaaaaccauccc

SEQ ID NO: 1397 - RNA, 20 nt, Artificial Sequence
  spacer sequence
ucccaaaaccaucccuccca

SEQ ID NO: 1398 - RNA, 20 nt, Artificial Sequence
  spacer sequence
caaaaccaucccucccaccc

SEQ ID NO: 1399 - RNA, 20 nt, Artificial Sequence
  spacer sequence
cucccacccccauguaugga

SEQ ID NO: 1400 - RNA, 20 nt, Artificial Sequence
  spacer sequence
cacccccauguauggaaaaa

SEQ ID NO: 1401 - RNA, 20 nt, Artificial Sequence
  spacer sequence
auacaugggggugggaggga

SEQ ID NO: 1402 - RNA, 20 nt, Artificial Sequence
  spacer sequence
cccaugaaacuggucccugg

SEQ ID NO: 1403 - RNA, 20 nt, Artificial Sequence
  spacer sequence
caugaaacuggucccuggug

SEQ ID NO: 1404 - RNA, 20 nt, Artificial Sequence
  spacer sequence
ugggagacaauuuuuccaua

SEQ ID NO: 1405 - RNA, 20 nt, Artificial Sequence
  spacer sequence
cuggugccuaaaagguuggg

SEQ ID NO: 1406 - RNA, 20 nt, Artificial Sequence
  spacer sequence
ccaaccuuuuaggcaccagg

SEQ ID NO: 1407 - RNA, 20 nt, Artificial Sequence
  spacer sequence
uguuuaaacuaauggucccc

SEQ ID NO: 1408 - RNA, 20 nt, Artificial Sequence
  spacer sequence
aagagaaucaaagcacauca

SEQ ID NO: 1409 - RNA, 20 nt, Artificial Sequence
  spacer sequence
agugcagaucccagagcugg

SEQ ID NO: 1410 - RNA, 20 nt, Artificial Sequence
  spacer sequence
gcacuggagccacuuggguu

SEQ ID NO: 1411 - RNA, 20 nt, Artificial Sequence
  spacer sequence
cagagcuggcacuuaaaagc

SEQ ID NO: 1412 - RNA, 20 nt, Artificial Sequence
  spacer sequence
gggaucugcacuggagccac

SEQ ID NO: 1413 - RNA, 20 nt, Artificial Sequence
  spacer sequence
acagcuuuuaagugccagcu

SEQ ID NO: 1414 - RNA, 20 nt, Artificial Sequence
  spacer sequence
caccuguaaucccagcacuu

SEQ ID NO: 1415 - RNA, 20 nt, Artificial Sequence
  spacer sequence
cucccucccuuucucccuuc

SEQ ID NO: 1416 - RNA, 20 nt, Artificial Sequence
  spacer sequence
cucccuuucucccuuccuuc

SEQ ID NO: 1417 - RNA, 20 nt, Artificial Sequence
  spacer sequence
cuuucucccuuccuuccuuu

SEQ ID NO: 1418 - RNA, 20 nt, Artificial Sequence
  spacer sequence
cccuuccuuccuuuccuucu

SEQ ID NO: 1419 - RNA, 20 nt, Artificial Sequence
  spacer sequence
cuuccuuccuuuccuucuuu

SEQ ID NO: 1420 - RNA, 20 nt, Artificial Sequence
  spacer sequence
uuccuuuccuucuuucuuuc

SEQ ID NO: 1421 - RNA, 20 nt, Artificial Sequence
  spacer sequence
uuuccuucuuucuuucuuuu

SEQ ID NO: 1422 - RNA, 20 nt, Artificial Sequence
  spacer sequence
uucuuucuuucuuuugagac

SEQ ID NO: 1423 - RNA, 20 nt, Artificial Sequence
  spacer sequence
uucuuucuuuugagacagga

SEQ ID NO: 1424 - RNA, 20 nt, Artificial Sequence
  spacer sequence
uucuuuugagacaggaucuu

SEQ ID NO: 1425 - RNA, 20 nt, Artificial Sequence
  spacer sequence
uuugagacaggaucuugcuc

SEQ ID NO: 1426 - RNA, 20 nt, Artificial Sequence
  spacer sequence
aaagaaagaaagaaggaaag

SEQ ID NO: 1427 - RNA, 20 nt, Artificial Sequence
  spacer sequence
caaaagaaagaaagaaggaa

SEQ ID NO: 1428 - RNA, 20 nt, Artificial Sequence
  spacer sequence
ugucucaaaagaaagaaaga

SEQ ID NO: 1429 - RNA, 20 nt, Artificial Sequence
  spacer sequence
ugcucuguugcccagauugg

SEQ ID NO: 1430 - RNA, 20 nt, Artificial Sequence
  spacer sequence
guugcccagauuggagugca

SEQ ID NO: 1431 - RNA, 20 nt, Artificial Sequence
  spacer sequence
gggcaacagagcaagauccu

SEQ ID NO: 1432 - RNA, 20 nt, Artificial Sequence
  spacer sequence
aaucugggcaacagagcaag

SEQ ID NO: 1433 - RNA, 20 nt, Artificial Sequence
  spacer sequence
ugcacuccaaucugggcaac

SEQ ID NO: 1434 - RNA, 20 nt, Artificial Sequence
  spacer sequence
uagcucacugcuugaacucc

SEQ ID NO: 1435 - RNA, 20 nt, Artificial Sequence
  spacer sequence
cugcuugaacuccugggcug

SEQ ID NO: 1436 - RNA, 20 nt, Artificial Sequence
  spacer sequence
caacucaauuuggagaggaa

SEQ ID NO: 1437 - RNA, 20 nt, Artificial Sequence
  spacer sequence
gcauuuguuucacaacucaa

SEQ ID NO: 1438 - RNA, 20 nt, Artificial Sequence
  spacer sequence
uuguuucugcauuuguuuca

SEQ ID NO: 1439 - RNA, 20 nt, Artificial Sequence
  spacer sequence
aaggucaaacaauucaaggc

SEQ ID NO: 1440 - RNA, 20 nt, Artificial Sequence
  spacer sequence
aacaauucaaggcaaaguuu

SEQ ID NO: 1441 - RNA, 20 nt, Artificial Sequence
  spacer sequence
aggcaaaguuuacaaccaug

SEQ ID NO: 1442 - RNA, 20 nt, Artificial Sequence
  spacer sequence
augguuguaaacuuugccuu

SEQ ID NO: 1443 - RNA, 20 nt, Artificial Sequence
  spacer sequence
uggguuuaaugaaucaguag

SEQ ID NO: 1444 - RNA, 20 nt, Artificial Sequence
  spacer sequence
uuaaacccaggacuggcugg

SEQ ID NO: 1445 - RNA, 20 nt, Artificial Sequence
  spacer sequence
guaggauccuaaaugaaauu

SEQ ID NO: 1446 - RNA, 20 nt, Artificial Sequence
  spacer sequence
uacugauucauuaaacccag

SEQ ID NO: 1447 - RNA, 20 nt, Artificial Sequence
  spacer sequence
uaaaugaaauugguaaauga

SEQ ID NO: 1448 - RNA, 20 nt, Artificial Sequence
  spacer sequence
uuuaggauccuacugauuca

SEQ ID NO: 1449 - RNA, 20 nt, Artificial Sequence
  spacer sequence
uuuaccaauuucauuuagga

SEQ ID NO: 1450 - RNA, 20 nt, Artificial Sequence
  spacer sequence
auaagcucuguccucaaagu

SEQ ID NO: 1451 - RNA, 20 nt, Artificial Sequence
  spacer sequence
guccucaaaguugaccauuc

SEQ ID NO: 1452 - RNA, 20 nt, Artificial Sequence
  spacer sequence
ucaaaguugaccauucgaca

SEQ ID NO: 1453 - RNA, 20 nt, Artificial Sequence
  spacer sequence
aaguugaccauucgacauuu

SEQ ID NO: 1454 - RNA, 20 nt, Artificial Sequence
  spacer sequence
acuuugaggacagagcuuau

SEQ ID NO: 1455 - RNA, 20 nt, Artificial Sequence
  spacer sequence
acauuuuuauuaaagucaca

SEQ ID NO: 1456 - RNA, 20 nt, Artificial Sequence
  spacer sequence
aauggucaacuuugaggaca

SEQ ID NO: 1457 - RNA, 20 nt, Artificial Sequence
  spacer sequence
cagaagaggacauagaagac

SEQ ID NO: 1458 - RNA, 20 nt, Artificial Sequence
  spacer sequence
gugacuuuaauaaaaauguc

SEQ ID NO: 1459 - RNA, 20 nt, Artificial Sequence
  spacer sequence
ucugugacuuuaauaaaaau

SEQ ID NO: 1460 - RNA, 20 nt, Artificial Sequence
  spacer sequence
ucuucugugacuuuaauaaa

SEQ ID NO: 1461 - RNA, 20 nt, Artificial Sequence
  spacer sequence
auguccucuucugugacuuu

SEQ ID NO: 1462 - RNA, 20 nt, Artificial Sequence
  spacer sequence
ucuauguccucuucugugac

SEQ ID NO: 1463 - RNA, 20 nt, Artificial Sequence
  spacer sequence
gauuuguaaguagcacaaaa

SEQ ID NO: 1464 - RNA, 20 nt, Artificial Sequence
  spacer sequence
gauagugucuucuauguccu

SEQ ID NO: 1465 - RNA, 20 nt, Artificial Sequence
  spacer sequence
aaucuaaaagaagacaucua

SEQ ID NO: 1466 - RNA, 20 nt, Artificial Sequence
  spacer sequence
aaaagaagacaucuaacaag

SEQ ID NO: 1467 - RNA, 20 nt, Artificial Sequence
  spacer sequence
uuuagauuugaguuuccuga

SEQ ID NO: 1468 - RNA, 20 nt, Artificial Sequence
  spacer sequence
ucuuuuagauuugaguuucc

SEQ ID NO: 1469 - RNA, 20 nt, Artificial Sequence
  spacer sequence
aacaagagauaaaugagaac

SEQ ID NO: 1470 - RNA, 20 nt, Artificial Sequence
  spacer sequence
uguuagaugucuucuuuuag

SEQ ID NO: 1471 - RNA, 20 nt, Artificial Sequence
  spacer sequence
cuuguuagaugucuucuuuu

SEQ ID NO: 1472 - RNA, 20 nt, Artificial Sequence
  spacer sequence
uuuaucucuuguuagauguc

SEQ ID NO: 1473 - RNA, 20 nt, Artificial Sequence
  spacer sequence
cauuuaucucuuguuagaug

SEQ ID NO: 1474 - RNA, 20 nt, Artificial Sequence
  spacer sequence
aaauacagggguucucauuu

SEQ ID NO: 1475 - RNA, 20 nt, Artificial Sequence
  spacer sequence
aacacaagggcagaacaguu

SEQ ID NO: 1476 - RNA, 20 nt, Artificial Sequence
  spacer sequence
cauuuuauuauagucaccca

SEQ ID NO: 1477 - RNA, 20 nt, Artificial Sequence
  spacer sequence
cccagaauauacauuaucaa

SEQ ID NO: 1478 - RNA, 20 nt, Artificial Sequence
  spacer sequence
gggugacuauaauaaaaugu

SEQ ID NO: 1479 - RNA, 20 nt, Artificial Sequence
  spacer sequence
aauaaagguuuguauauaau

SEQ ID NO: 1480 - RNA, 20 nt, Artificial Sequence
  spacer sequence
uaaugagaaaaacucaugua

SEQ ID NO: 1481 - RNA, 20 nt, Artificial Sequence
  spacer sequence
uuaggaguguauuauauaca

SEQ ID NO: 1482 - RNA, 20 nt, Artificial Sequence
  spacer sequence
cauuaggaguguauuauaua

SEQ ID NO: 1483 - RNA, 20 nt, Artificial Sequence
  spacer sequence
uguaauauuacccuaacauu

SEQ ID NO: 1484 - RNA, 20 nt, Artificial Sequence
  spacer sequence
auuuuaaacaauaaauguua

SEQ ID NO: 1485 - RNA, 20 nt, Artificial Sequence
  spacer sequence
aacauucaaaaaccuguugg

SEQ ID NO: 1486 - RNA, 20 nt, Artificial Sequence
  spacer sequence
aaaaccuguuggaauuuggg

SEQ ID NO: 1487 - RNA, 20 nt, Artificial Sequence
  spacer sequence
uugaaccgaaacaagaggaa

SEQ ID NO: 1488 - RNA, 20 nt, Artificial Sequence
  spacer sequence
aagacggguagccuccuguc

SEQ ID NO: 1489 - RNA, 20 nt, Artificial Sequence
  spacer sequence
guucaaagacggguagccuc

SEQ ID NO: 1490 - RNA, 20 nt, Artificial Sequence
  spacer sequence
uguuucgguucaaagacggg

SEQ ID NO: 1491 - RNA, 20 nt, Artificial Sequence
  spacer sequence
ucuuguuucgguucaaagac

SEQ ID NO: 1492 - RNA, 20 nt, Artificial Sequence
  spacer sequence
cacccuggccuuguuccucu

SEQ ID NO: 1493 - RNA, 20 nt, Artificial Sequence
  spacer sequence
uucccacccuggccuuguuc

SEQ ID NO: 1494 - RNA, 20 nt, Artificial Sequence
  spacer sequence
uuuccauuuacacuagaguu

SEQ ID NO: 1495 - RNA, 20 nt, Artificial Sequence
  spacer sequence
auuuacacuagaguuaccua

SEQ ID NO: 1496 - RNA, 20 nt, Artificial Sequence
  spacer sequence
aguguaaauggaaacgaagu

SEQ ID NO: 1497 - RNA, 20 nt, Artificial Sequence
  spacer sequence
uuuuguagguaacucuagug

SEQ ID NO: 1498 - RNA, 20 nt, Artificial Sequence
  spacer sequence
cccaaugucaaaacaacagu

SEQ ID NO: 1499 - RNA, 20 nt, Artificial Sequence
  spacer sequence
caaugucaaaacaacaguga

SEQ ID NO: 1500 - RNA, 20 nt, Artificial Sequence
  spacer sequence
aaacaacagugagguggugg

SEQ ID NO: 1501 - RNA, 20 nt, Artificial Sequence
  spacer sequence
cuguuguuuugacauuggga

SEQ ID NO: 1502 - RNA, 20 nt, Artificial Sequence
  spacer sequence
cuaagacacaguucuguggc

SEQ ID NO: 1503 - RNA, 20 nt, Artificial Sequence
  spacer sequence
uagugaccagcagguggcgc

SEQ ID NO: 1504 - RNA, 20 nt, Artificial Sequence
  spacer sequence
guggcaacugaggcuugauc

SEQ ID NO: 1505 - RNA, 20 nt, Artificial Sequence
  spacer sequence
guugccacagaacugugucu

SEQ ID NO: 1506 - RNA, 20 nt, Artificial Sequence
  spacer sequence
agccucaguugccacagaac

SEQ ID NO: 1507 - RNA, 20 nt, Artificial Sequence
  spacer sequence
cuuagugguugugaggagga

SEQ ID NO: 1508 - RNA, 20 nt, Artificial Sequence
  spacer sequence
uagugguugugaggaggaga

SEQ ID NO: 1509 - RNA, 20 nt, Artificial Sequence
  spacer sequence
caaccacuaagagaucaagc

SEQ ID NO: 1510 - RNA, 20 nt, Artificial Sequence
  spacer sequence
ucacaaccacuaagagauca

SEQ ID NO: 1511 - RNA, 20 nt, Artificial Sequence
  spacer sequence
uccucacaaccacuaagaga

SEQ ID NO: 1512 - RNA, 20 nt, Artificial Sequence
  spacer sequence
ccuccucacaaccacuaaga

SEQ ID NO: 1513 - RNA, 20 nt, Artificial Sequence
  spacer sequence
ccagggguuaccugggaaga

SEQ ID NO: 1514 - RNA, 20 nt, Artificial Sequence
  spacer sequence
auuugugccuuuguuuaguc

SEQ ID NO: 1515 - RNA, 20 nt, Artificial Sequence
  spacer sequence
ccugcacagguauuuccauu

SEQ ID NO: 1516 - RNA, 20 nt, Artificial Sequence
  spacer sequence
uccccugcacagguauuucc

SEQ ID NO: 1517 - RNA, 20 nt, Artificial Sequence
  spacer sequence
cauuuucauccccugcacag

SEQ ID NO: 1518 - RNA, 20 nt, Artificial Sequence
  spacer sequence
uucacauuuucauccccugc

SEQ ID NO: 1519 - RNA, 20 nt, Artificial Sequence
  spacer sequence
gggcuuguuacccuauuauu

SEQ ID NO: 1520 - RNA, 20 nt, Artificial Sequence
  spacer sequence
ucagggcuuguuacccuauu

SEQ ID NO: 1521 - RNA, 20 nt, Artificial Sequence
  spacer sequence
uuuuauuucccaagcauugu

SEQ ID NO: 1522 - RNA, 20 nt, Artificial Sequence
  spacer sequence
caagcauuguuuuaccccaa

SEQ ID NO: 1523 - RNA, 20 nt, Artificial Sequence
  spacer sequence
agagauggucuggaaagagg

SEQ ID NO: 1524 - RNA, 20 nt, Artificial Sequence
  spacer sequence
uaaaucaagagauggucugg

SEQ ID NO: 1525 - RNA, 20 nt, Artificial Sequence
  spacer sequence
cagagcauacaucuuuuuaa

SEQ ID NO: 1526 - RNA, 20 nt, Artificial Sequence
  spacer sequence
gagcauacaucuuuuuaaaa

SEQ ID NO: 1527 - RNA, 20 nt, Artificial Sequence
  spacer sequence
gagaaaccagccugucguaa

SEQ ID NO: 1528 - RNA, 20 nt, Artificial Sequence
  spacer sequence
uuuuaaaauuauuauuaaau

SEQ ID NO: 1529 - RNA, 20 nt, Artificial Sequence
  spacer sequence
auaauuauuuaauaauaauu

SEQ ID NO: 1530 - RNA, 20 nt, Artificial Sequence
  spacer sequence
cuggaaauugcaaagauaga

SEQ ID NO: 1531 - RNA, 20 nt, Artificial Sequence
  spacer sequence
agugaaucuauaauuauuua

SEQ ID NO: 1532 - RNA, 20 nt, Artificial Sequence
  spacer sequence
uugcaauuuccagugaaucu

SEQ ID NO: 1533 - RNA, 20 nt, Artificial Sequence
  spacer sequence
aucuuugcaauuuccaguga

SEQ ID NO: 1534 - RNA, 20 nt, Artificial Sequence
  spacer sequence
ugucuaucuuugcaauuucc

SEQ ID NO: 1535 - RNA, 20 nt, Artificial Sequence
  spacer sequence
guccugucuaucuuugcaau

SEQ ID NO: 1536 - RNA, 20 nt, Artificial Sequence
  spacer sequence
uauuuuuaguacagacgggg

SEQ ID NO: 1537 - RNA, 20 nt, Artificial Sequence
  spacer sequence
agcuacucaggaggcugagg

SEQ ID NO: 1538 - RNA, 20 nt, Artificial Sequence
  spacer sequence
ggaggcugaggcaggagaau

SEQ ID NO: 1539 - RNA, 20 nt, Artificial Sequence
  spacer sequence
ugaguagcuggauuacaggc

SEQ ID NO: 1540 - RNA, 20 nt, Artificial Sequence
  spacer sequence
gccuccugaguagcuggauu

SEQ ID NO: 1541 - RNA, 20 nt, Artificial Sequence
  spacer sequence
ugccucagccuccugaguag

SEQ ID NO: 1542 - RNA, 20 nt, Artificial Sequence
  spacer sequence
ccugccucagccuccugagu

SEQ ID NO: 1543 - RNA, 20 nt, Artificial Sequence
  spacer sequence
agcuauucuccugccucagc

SEQ ID NO: 1544 - RNA, 20 nt, Artificial Sequence
  spacer sequence
uggguucaagcuauucuccu

SEQ ID NO: 1545 - RNA, 20 nt, Artificial Sequence
  spacer sequence
acuuccuggguucaagcuau

SEQ ID NO: 1546 - RNA, 20 nt, Artificial Sequence
  spacer sequence
cugcaaccuccacuuccugg

SEQ ID NO: 1547 - RNA, 20 nt, Artificial Sequence
  spacer sequence
ggucacugcaaccuccacuu

SEQ ID NO: 1548 - RNA, 20 nt, Artificial Sequence
  spacer sequence
caggucacugcaaccuccac

SEQ ID NO: 1549 - RNA, 20 nt, Artificial Sequence
  spacer sequence
cgccacugcacuccagccua

SEQ ID NO: 1550 - RNA, 20 nt, Artificial Sequence
  spacer sequence
agccuaggugacagagcaag

SEQ ID NO: 1551 - RNA, 20 nt, Artificial Sequence
  spacer sequence
ccuaggcuggagugcagugg

SEQ ID NO: 1552 - RNA, 20 nt, Artificial Sequence
  spacer sequence
cuuucuagcaaucccagguc

SEQ ID NO: 1553 - RNA, 20 nt, Artificial Sequence
  spacer sequence
agcaaucccaggucuuuaga

SEQ ID NO: 1554 - RNA, 20 nt, Artificial Sequence
  spacer sequence
caggucuuuagacaaacuca

SEQ ID NO: 1555 - RNA, 20 nt, Artificial Sequence
  spacer sequence
uuagacaaacucaaccaauu

SEQ ID NO: 1556 - RNA, 20 nt, Artificial Sequence
  spacer sequence
aaagaccugggauugcuaga

SEQ ID NO: 1557 - RNA, 20 nt, Artificial Sequence
  spacer sequence
accaauugucaaccagaaaa

SEQ ID NO: 1558 - RNA, 20 nt, Artificial Sequence
  spacer sequence
accagaaaaugcuuaaauuc

SEQ ID NO: 1559 - RNA, 20 nt, Artificial Sequence
  spacer sequence
gguugacaauugguugaguu

SEQ ID NO: 1560 - RNA, 20 nt, Artificial Sequence
  spacer sequence
ccuggaggcgcccccccacu

SEQ ID NO: 1561 - RNA, 20 nt, Artificial Sequence
  spacer sequence
aggugaauuuaagcauuuuc

SEQ ID NO: 1562 - RNA, 20 nt, Artificial Sequence
  spacer sequence
uccccugcuuugaguugucc

SEQ ID NO: 1563 - RNA, 20 nt, Artificial Sequence
  spacer sequence
ccugcuuugaguugucccuc

SEQ ID NO: 1564 - RNA, 20 nt, Artificial Sequence
  spacer sequence
aagcaggggaugaagugggg

SEQ ID NO: 1565 - RNA, 20 nt, Artificial Sequence
  spacer sequence
cucuuuucugggccagacca

SEQ ID NO: 1566 - RNA, 20 nt, Artificial Sequence
  spacer sequence
uuucugggccagaccaauga

SEQ ID NO: 1567 - RNA, 20 nt, Artificial Sequence
  spacer sequence
gggccagaccaaugaauuca

SEQ ID NO: 1568 - RNA, 20 nt, Artificial Sequence
  spacer sequence
ggcccagaaaagagggacaa

SEQ ID NO: 1569 - RNA, 20 nt, Artificial Sequence
  spacer sequence
uuggucuggcccagaaaaga

SEQ ID NO: 1570 - RNA, 20 nt, Artificial Sequence
  spacer sequence
augaauuucuuaaauguauu

SEQ ID NO: 1571 - RNA, 20 nt, Artificial Sequence
  spacer sequence
uugaauucauuggucuggcc

SEQ ID NO: 1572 - RNA, 20 nt, Artificial Sequence
  spacer sequence
uaaauguauuugauugaugu

SEQ ID NO: 1573 - RNA, 20 nt, Artificial Sequence
  spacer sequence
aauacauuuaagaaauucau

SEQ ID NO: 1574 - RNA, 20 nt, Artificial Sequence
  spacer sequence
aucaaauacauuuaagaaau

SEQ ID NO: 1575 - RNA, 20 nt, Artificial Sequence
  spacer sequence
caugucucucuaaaauguau

SEQ ID NO: 1576 - RNA, 20 nt, Artificial Sequence
  spacer sequence
ugucucucuaaaauguauaa

SEQ ID NO: 1577 - RNA, 20 nt, Artificial Sequence
  spacer sequence
cucuaaaauguauaaaacca

SEQ ID NO: 1578 - RNA, 20 nt, Artificial Sequence
  spacer sequence
cuaaaauguauaaaaccaag

SEQ ID NO: 1579 - RNA, 20 nt, Artificial Sequence
  spacer sequence
aaaauguauaaaaccaagcu

SEQ ID NO: 1580 - RNA, 20 nt, Artificial Sequence
  spacer sequence
uggucacauguucugaggac

SEQ ID NO: 1581 - RNA, 20 nt, Artificial Sequence
  spacer sequence
cucugagccuuucugucuug

SEQ ID NO: 1582 - RNA, 20 nt, Artificial Sequence
  spacer sequence
ucucucugagccuuucuguc

SEQ ID NO: 1583 - RNA, 20 nt, Artificial Sequence
  spacer sequence
agggccuggagaaggugcug

SEQ ID NO: 1584 - RNA, 20 nt, Artificial Sequence
  spacer sequence
aggcccuugagcuggccugg

SEQ ID NO: 1585 - RNA, 20 nt, Artificial Sequence
  spacer sequence
ccaggcccuugagcuggccu

SEQ ID NO: 1586 - RNA, 20 nt, Artificial Sequence
  spacer sequence
agcaccuucuccaggcccuu

SEQ ID NO: 1587 - RNA, 20 nt, Artificial Sequence
  spacer sequence
uggucccgagaccagcucgg

SEQ ID NO: 1588 - RNA, 20 nt, Artificial Sequence
  spacer sequence
cgagaccagcucggucaggg

SEQ ID NO: 1589 - RNA, 20 nt, Artificial Sequence
  spacer sequence
ggaccaagaguaauuuuuuc

SEQ ID NO: 1590 - RNA, 20 nt, Artificial Sequence
  spacer sequence
cgggaccaagaguaauuuuu

SEQ ID NO: 1591 - RNA, 20 nt, Artificial Sequence
  spacer sequence
gucagggagacccuaaccca

SEQ ID NO: 1592 - RNA, 20 nt, Artificial Sequence
  spacer sequence
gggagacccuaacccagcgg

SEQ ID NO: 1593 - RNA, 20 nt, Artificial Sequence
  spacer sequence
uggggccaguuuauggcugg

SEQ ID NO: 1594 - RNA, 20 nt, Artificial Sequence
  spacer sequence
agccauaaacuggccccaag

SEQ ID NO: 1595 - RNA, 20 nt, Artificial Sequence
  spacer sequence
caacaacuuggaauggcacu

SEQ ID NO: 1596 - RNA, 20 nt, Artificial Sequence
  spacer sequence
aaguuguugggagcaagccc

SEQ ID NO: 1597 - RNA, 20 nt, Artificial Sequence
  spacer sequence
agugccauuccaaguuguug

SEQ ID NO: 1598 - RNA, 20 nt, Artificial Sequence
  spacer sequence
aggagcuuuggaugauuggc

SEQ ID NO: 1599 - RNA, 20 nt, Artificial Sequence
  spacer sequence
uggaacccuucaagugccau

SEQ ID NO: 1600 - RNA, 20 nt, Artificial Sequence
  spacer sequence
cugcagucucuguauacaca

SEQ ID NO: 1601 - RNA, 20 nt, Artificial Sequence
  spacer sequence
uuuguacucacugcagucuc

SEQ ID NO: 1602 - RNA, 20 nt, Artificial Sequence
  spacer sequence
acagacaggcagaggggaac

SEQ ID NO: 1603 - RNA, 20 nt, Artificial Sequence
  spacer sequence
guugacccuccuuuguacuc

SEQ ID NO: 1604 - RNA, 20 nt, Artificial Sequence
  spacer sequence
gccugucuguugacccuccu

SEQ ID NO: 1605 - RNA, 20 nt, Artificial Sequence
  spacer sequence
ccucugccugucuguugacc

SEQ ID NO: 1606 - RNA, 20 nt, Artificial Sequence
  spacer sequence
aauguuccccucugccuguc

SEQ ID NO: 1607 - RNA, 20 nt, Artificial Sequence
  spacer sequence
ccuugaacucccugacaaga

SEQ ID NO: 1608 - RNA, 20 nt, Artificial Sequence
  spacer sequence
aggugacagugucaaauguu

SEQ ID NO: 1609 - RNA, 20 nt, Artificial Sequence
  spacer sequence
cugacaagauccuuugagau

SEQ ID NO: 1610 - RNA, 20 nt, Artificial Sequence
  spacer sequence
gccaucaccacaacccaucu

SEQ ID NO: 1611 - RNA, 20 nt, Artificial Sequence
  spacer sequence
ccacaacccaucuccagaac

SEQ ID NO: 1612 - RNA, 20 nt, Artificial Sequence
  spacer sequence
ccagaacuuuccaucauccu

SEQ ID NO: 1613 - RNA, 20 nt, Artificial Sequence
  spacer sequence
agaacuuuccaucauccuaa

SEQ ID NO: 1614 - RNA, 20 nt, Artificial Sequence
  spacer sequence
ggagauggguuguggugaug

SEQ ID NO: 1615 - RNA, 20 nt, Artificial Sequence
  spacer sequence
aucauccuaagcuaaaacuc

SEQ ID NO: 1616 - RNA, 20 nt, Artificial Sequence
  spacer sequence
uccuaagcuaaaacucugua

SEQ ID NO: 1617 - RNA, 20 nt, Artificial Sequence
  spacer sequence
uaagcuaaaacucuguaccc

SEQ ID NO: 1618 - RNA, 20 nt, Artificial Sequence
  spacer sequence
guacccauuuaacaauaacc

SEQ ID NO: 1619 - RNA, 20 nt, Artificial Sequence
  spacer sequence
ugcuccuccagcucccagaa

SEQ ID NO: 1620 - RNA, 20 nt, Artificial Sequence
  spacer sequence
uccagcucccagaaaccuuu

SEQ ID NO: 1621 - RNA, 20 nt, Artificial Sequence
  spacer sequence
agcucccagaaaccuuuauu

SEQ ID NO: 1622 - RNA, 20 nt, Artificial Sequence
  spacer sequence
cagaaaccuuuauucuacuu

SEQ ID NO: 1623 - RNA, 20 nt, Artificial Sequence
  spacer sequence
gggagcuggaggagcacgaa

SEQ ID NO: 1624 - RNA, 20 nt, Artificial Sequence
  spacer sequence
acuuucugugucuauaaauu

SEQ ID NO: 1625 - RNA, 20 nt, Artificial Sequence
  spacer sequence
gugucuauaaauuugccucc

SEQ ID NO: 1626 - RNA, 20 nt, Artificial Sequence
  spacer sequence
auaaauuugccuccucuaag

SEQ ID NO: 1627 - RNA, 20 nt, Artificial Sequence
  spacer sequence
ucuaagugccuuauguaagu

SEQ ID NO: 1628 - RNA, 20 nt, Artificial Sequence
  spacer sequence
aagugccuuauguaagugga

SEQ ID NO: 1629 - RNA, 20 nt, Artificial Sequence
  spacer sequence
gccaaaaaaaauuauaaucu

SEQ ID NO: 1630 - RNA, 20 nt, Artificial Sequence
  spacer sequence
cacauauaaucccagcacuc

SEQ ID NO: 1631 - RNA, 20 nt, Artificial Sequence
  spacer sequence
cagcacucugggaggccaag

SEQ ID NO: 1632 - RNA, 20 nt, Artificial Sequence
  spacer sequence
gggaggccaaggcaggagga

SEQ ID NO: 1633 - RNA, 20 nt, Artificial Sequence
  spacer sequence
cagagugcugggauuauaug

SEQ ID NO: 1634 - RNA, 20 nt, Artificial Sequence
  spacer sequence
ugccuuggccucccagagug

SEQ ID NO: 1635 - RNA, 20 nt, Artificial Sequence
  spacer sequence
uccugccuuggccucccaga

SEQ ID NO: 1636 - RNA, 20 nt, Artificial Sequence
  spacer sequence
cuugaggccaggaguucgag

SEQ ID NO: 1637 - RNA, 20 nt, Artificial Sequence
  spacer sequence
agugauccuccugccuuggc

SEQ ID NO: 1638 - RNA, 20 nt, Artificial Sequence
  spacer sequence
uggccucaagugauccuccu

SEQ ID NO: 1639 - RNA, 20 nt, Artificial Sequence
  spacer sequence
agaccagccuggccaacaug

SEQ ID NO: 1640 - RNA, 20 nt, Artificial Sequence
  spacer sequence
aacuccuggccucaagugau

SEQ ID NO: 1641 - RNA, 20 nt, Artificial Sequence
  spacer sequence
cgaacuccuggccucaagug

SEQ ID NO: 1642 - RNA, 20 nt, Artificial Sequence
  spacer sequence
ccauguuggccaggcugguc

SEQ ID NO: 1643 - RNA, 20 nt, Artificial Sequence
  spacer sequence
cuacuaaaaauacaaaaaug

SEQ ID NO: 1644 - RNA, 20 nt, Artificial Sequence
  spacer sequence
acuaaaaauacaaaaauggg

SEQ ID NO: 1645 - RNA, 20 nt, Artificial Sequence
  spacer sequence
cacucugucgcccagggugg

SEQ ID NO: 1646 - RNA, 20 nt, Artificial Sequence
  spacer sequence
agcucaaaaaaaaaaaaaaa

SEQ ID NO: 1647 - RNA, 20 nt, Artificial Sequence
  spacer sequence
aaaaaaaaaaaaaaaaaaaa

SEQ ID NO: 1648 - RNA, 20 nt, Artificial Sequence
  spacer sequence
uuuuuuuuuuuuuuuuuuuu

SEQ ID NO: 1649 - RNA, 20 nt, Artificial Sequence
  spacer sequence
gcagacaucgugcccuuugc

SEQ ID NO: 1650 - RNA, 20 nt, Artificial Sequence
  spacer sequence
gcugagcacuucuuuuuuuu

SEQ ID NO: 1651 - RNA, 20 nt, Artificial Sequence
  spacer sequence
ugcccuuugcccuuuggcua

SEQ ID NO: 1652 - RNA, 20 nt, Artificial Sequence
  spacer sequence
uguuuuaaaaauaccuuuuu

SEQ ID NO: 1653 - RNA, 20 nt, Artificial Sequence
  spacer sequence
guuuaguauacaaaacugaa

SEQ ID NO: 1654 - RNA, 20 nt, Artificial Sequence
  spacer sequence
aaugcaauuacuucuguuua

SEQ ID NO: 1655 - RNA, 20 nt, Artificial Sequence
  spacer sequence
ucaaaugcaauuacuucugu

SEQ ID NO: 1656 - RNA, 20 nt, Artificial Sequence
  spacer sequence
uuugucaucaaaugcaauua

SEQ ID NO: 1657 - RNA, 20 nt, Artificial Sequence
  spacer sequence
uuuuccuuugucaucaaaug

SEQ ID NO: 1658 - RNA, 20 nt, Artificial Sequence
  spacer sequence
uucuuuuuccuuugucauca

SEQ ID NO: 1659 - RNA, 20 nt, Artificial Sequence
  spacer sequence
gcaaagggaucauuuggggu

SEQ ID NO: 1660 - RNA, 20 nt, Artificial Sequence
  spacer sequence
cuuugcugauuucauucuuu

SEQ ID NO: 1661 - RNA, 20 nt, Artificial Sequence
  spacer sequence
uuugggguuuuuuggcucag

SEQ ID NO: 1662 - RNA, 20 nt, Artificial Sequence
  spacer sequence
gugauuccuguggcagccgu

SEQ ID NO: 1663 - RNA, 20 nt, Artificial Sequence
  spacer sequence
cugagccaaaaaaccccaaa

SEQ ID NO: 1664 - RNA, 20 nt, Artificial Sequence
  spacer sequence
uguggcagccguuguggugg

SEQ ID NO: 1665 - RNA, 20 nt, Artificial Sequence
  spacer sequence
gugucuauuugccuaggcca

SEQ ID NO: 1666 - RNA, 20 nt, Artificial Sequence
  spacer sequence
auuugccuaggccaugguac

SEQ ID NO: 1667 - RNA, 20 nt, Artificial Sequence
  spacer sequence
gguaccgguccagauguugu

SEQ ID NO: 1668 - RNA, 20 nt, Artificial Sequence
  spacer sequence
agauguuguaaagguauagg

SEQ ID NO: 1669 - RNA, 20 nt, Artificial Sequence
  spacer sequence
ggaccgguaccugaccaaac

SEQ ID NO: 1670 - RNA, 20 nt, Artificial Sequence
  spacer sequence
ugagauagagucucacucug

SEQ ID NO: 1671 - RNA, 20 nt, Artificial Sequence
  spacer sequence
agaaaaaaaauauaccuaua

SEQ ID NO: 1672 - RNA, 20 nt, Artificial Sequence
  spacer sequence
caagaaaaaaaauauaccua

SEQ ID NO: 1673 - RNA, 20 nt, Artificial Sequence
  spacer sequence
aucucaagaaaaaaaauaua

SEQ ID NO: 1674 - RNA, 20 nt, Artificial Sequence
  spacer sequence
cacucugucgcccaggcugg

SEQ ID NO: 1675 - RNA, 20 nt, Artificial Sequence
  spacer sequence
cucugucgcccaggcuggag

SEQ ID NO: 1676 - RNA, 20 nt, Artificial Sequence
  spacer sequence
acuuaaaauacaaaaaaaau

SEQ ID NO: 1677 - RNA, 20 nt, Artificial Sequence
  spacer sequence
cuacuuaaaauacaaaaaaa

SEQ ID NO: 1678 - RNA, 20 nt, Artificial Sequence
  spacer sequence
gucucuacuuaaaauacaaa

SEQ ID NO: 1679 - RNA, 20 nt, Artificial Sequence
  spacer sequence
ccauguuggccagacugguc

SEQ ID NO: 1680 - RNA, 20 nt, Artificial Sequence
  spacer sequence
ggccaacauggugaaacucc

SEQ ID NO: 1681 - RNA, 20 nt, Artificial Sequence
  spacer sequence
cgaacuccuggacucaagug

SEQ ID NO: 1682 - RNA, 20 nt, Artificial Sequence
  spacer sequence
aacuccuggacucaagugau

SEQ ID NO: 1683 - RNA, 20 nt, Artificial Sequence
  spacer sequence
agaccagucuggccaacaug

SEQ ID NO: 1684 - RNA, 20 nt, Artificial Sequence
  spacer sequence
uggacucaagugaucugucc

SEQ ID NO: 1685 - RNA, 20 nt, Artificial Sequence
  spacer sequence
aggaguucgagaccagucug

SEQ ID NO: 1686 - RNA, 20 nt, Artificial Sequence
  spacer sequence
agugaucuguccaccuuggc

SEQ ID NO: 1687 - RNA, 20 nt, Artificial Sequence
  spacer sequence
cuugaguccaggaguucgag

SEQ ID NO: 1688 - RNA, 20 nt, Artificial Sequence
  spacer sequence
guccaccuuggccucccgaa

SEQ ID NO: 1689 - RNA, 20 nt, Artificial Sequence
  spacer sequence
auaauguggguaugcgguau

SEQ ID NO: 1690 - RNA, 20 nt, Artificial Sequence
  spacer sequence
aucaguugaacaccuuaaga

SEQ ID NO: 1691 - RNA, 20 nt, Artificial Sequence
  spacer sequence
guugaacaccuuaagagaaa

SEQ ID NO: 1692 - RNA, 20 nt, Artificial Sequence
  spacer sequence
acugauagauaccgcauacc

SEQ ID NO: 1693 - RNA, 20 nt, Artificial Sequence
  spacer sequence
uaagguguucaacugauaga

SEQ ID NO: 1694 - RNA, 20 nt, Artificial Sequence
  spacer sequence
cuuaagguguucaacugaua

SEQ ID NO: 1695 - RNA, 20 nt, Artificial Sequence
  spacer sequence
uuucucuuaagguguucaac

SEQ ID NO: 1696 - RNA, 20 nt, Artificial Sequence
  spacer sequence
gucuuuucucuuaagguguu

SEQ ID NO: 1697 - RNA, 20 nt, Artificial Sequence
  spacer sequence
ccugaagaggagggaauucu

SEQ ID NO: 1698 - RNA, 20 nt, Artificial Sequence
  spacer sequence
ggggacaucagucuuuucuc

SEQ ID NO: 1699 - RNA, 20 nt, Artificial Sequence
  spacer sequence
ucaggggacaucagucuuuu

SEQ ID NO: 1700 - RNA, 20 nt, Artificial Sequence
  spacer sequence
ucuucaggggacaucagucu

SEQ ID NO: 1701 - RNA, 20 nt, Artificial Sequence
  spacer sequence
cuccucuucaggggacauca

SEQ ID NO: 1702 - RNA, 20 nt, Artificial Sequence
  spacer sequence
gucuccagccuaccuuggga

SEQ ID NO: 1703 - RNA, 20 nt, Artificial Sequence
  spacer sequence
ccagccuaccuugggacuga

SEQ ID NO: 1704 - RNA, 20 nt, Artificial Sequence
  spacer sequence
agccuaccuugggacugaag

SEQ ID NO: 1705 - RNA, 20 nt, Artificial Sequence
  spacer sequence
caaaaaaaaauaaaaagaaa

SEQ ID NO: 1706 - RNA, 20 nt, Artificial Sequence
  spacer sequence
gucucaaaaaaaaauaaaaa

SEQ ID NO: 1707 - RNA, 20 nt, Artificial Sequence
  spacer sequence
ugcucugucgcccaggcugg

SEQ ID NO: 1708 - RNA, 20 nt, Artificial Sequence
  spacer sequence
gucgcccaggcuggagugca

SEQ ID NO: 1709 - RNA, 20 nt, Artificial Sequence
  spacer sequence
cccaggcuggagugcagugg

SEQ ID NO: 1710 - RNA, 20 nt, Artificial Sequence
  spacer sequence
agccugggcgacagagcagg

SEQ ID NO: 1711 - RNA, 20 nt, Artificial Sequence
  spacer sequence
ugccacugcacuccagccug

SEQ ID NO: 1712 - RNA, 20 nt, Artificial Sequence
  spacer sequence
uggcucacugcaaccucugc

SEQ ID NO: 1713 - RNA, 20 nt, Artificial Sequence
  spacer sequence
cugcaaccucugccucccag

SEQ ID NO: 1714 - RNA, 20 nt, Artificial Sequence
  spacer sequence
gccucccagguucaagcgau

SEQ ID NO: 1715 - RNA, 20 nt, Artificial Sequence
  spacer sequence
cagguucaagcgauucuccu

SEQ ID NO: 1716 - RNA, 20 nt, Artificial Sequence
  spacer sequence
agcgauucuccugccucagc

SEQ ID NO: 1717 - RNA, 20 nt, Artificial Sequence
  spacer sequence
cuugaaccugggaggcagag

SEQ ID NO: 1718 - RNA, 20 nt, Artificial Sequence
  spacer sequence
ccugccucagccucccaagu

SEQ ID NO: 1719 - RNA, 20 nt, Artificial Sequence
  spacer sequence
gccggcaaaauggcuguucu

SEQ ID NO: 1720 - RNA, 20 nt, Artificial Sequence
  spacer sequence
gcuuucucaggaacuuaguu

SEQ ID NO: 1721 - RNA, 20 nt, Artificial Sequence
  spacer sequence
caggaacuuaguuauuacua

SEQ ID NO: 1722 - RNA, 20 nt, Artificial Sequence
  spacer sequence
ggaacuuaguuauuacuauu

SEQ ID NO: 1723 - RNA, 20 nt, Artificial Sequence
  spacer sequence
ugagaaagcagacugcuguu

SEQ ID NO: 1724 - RNA, 20 nt, Artificial Sequence
  spacer sequence
aauaauaguaauaacuaagu

SEQ ID NO: 1725 - RNA, 20 nt, Artificial Sequence
  spacer sequence
caaauaauaguaauaacuaa

SEQ ID NO: 1726 - RNA, 20 nt, Artificial Sequence
  spacer sequence
cacucugucacccaggcugg

SEQ ID NO: 1727 - RNA, 20 nt, Artificial Sequence
  spacer sequence
ccgcucuuagagaugaacau

SEQ ID NO: 1728 - RNA, 20 nt, Artificial Sequence
  spacer sequence
gcucuuagagaugaacauau

SEQ ID NO: 1729 - RNA, 20 nt, Artificial Sequence
  spacer sequence
uagagaugaacauauugcug

SEQ ID NO: 1730 - RNA, 20 nt, Artificial Sequence
  spacer sequence
aagagcggagaaaaggacua

SEQ ID NO: 1731 - RNA, 20 nt, Artificial Sequence
  spacer sequence
cuaagagcggagaaaaggac

SEQ ID NO: 1732 - RNA, 20 nt, Artificial Sequence
  spacer sequence
ucucuaagagcggagaaaag

SEQ ID NO: 1733 - RNA, 20 nt, Artificial Sequence
  spacer sequence
guguguuuguuuucaguuga

SEQ ID NO: 1734 - RNA, 20 nt, Artificial Sequence
  spacer sequence
guugagcaucaguugaagga

SEQ ID NO: 1735 - RNA, 20 nt, Artificial Sequence
  spacer sequence
acugaaaacaaacacacaga

SEQ ID NO: 1736 - RNA, 20 nt, Artificial Sequence
  spacer sequence
guugaaggaauugcuugguu

SEQ ID NO: 1737 - RNA, 20 nt, Artificial Sequence
  spacer sequence
acugaugcucaacugaaaac

SEQ ID NO: 1738 - RNA, 20 nt, Artificial Sequence
  spacer sequence
uucaacugaugcucaacuga

SEQ ID NO: 1739 - RNA, 20 nt, Artificial Sequence
  spacer sequence
uguccaguaagaaugagggc

SEQ ID NO: 1740 - RNA, 20 nt, Artificial Sequence
  spacer sequence
aguaagaaugagggccuggc

SEQ ID NO: 1741 - RNA, 20 nt, Artificial Sequence
  spacer sequence
uacuggacaggagaguugca

SEQ ID NO: 1742 - RNA, 20 nt, Artificial Sequence
  spacer sequence
uucuuacuggacaggagagu

SEQ ID NO: 1743 - RNA, 20 nt, Artificial Sequence
  spacer sequence
gauuucacuaaacacauuuc

SEQ ID NO: 1744 - RNA, 20 nt, Artificial Sequence
  spacer sequence
gacaguaggccaggcccuca

SEQ ID NO: 1745 - RNA, 20 nt, Artificial Sequence
  spacer sequence
cuaaacacauuucuggacag

SEQ ID NO: 1746 - RNA, 20 nt, Artificial Sequence
  spacer sequence
ggacaguggugugcauuaag

SEQ ID NO: 1747 - RNA, 20 nt, Artificial Sequence
  spacer sequence
agaaauguguuuagugaaau

SEQ ID NO: 1748 - RNA, 20 nt, Artificial Sequence
  spacer sequence
uaaugcacaccacuguccag

SEQ ID NO: 1749 - RNA, 20 nt, Artificial Sequence
  spacer sequence
cuucauaacccuccccaaac

SEQ ID NO: 1750 - RNA, 20 nt, Artificial Sequence
  spacer sequence
ucauaacccuccccaaacga

SEQ ID NO: 1751 - RNA, 20 nt, Artificial Sequence
  spacer sequence
uaacccuccccaaacgaguc

SEQ ID NO: 1752 - RNA, 20 nt, Artificial Sequence
  spacer sequence
ccaaacgagucuucagucau

SEQ ID NO: 1753 - RNA, 20 nt, Artificial Sequence
  spacer sequence
uuuggggaggguuaugaaga

SEQ ID NO: 1754 - RNA, 20 nt, Artificial Sequence
  spacer sequence
ucagucauuugaguuugcau

SEQ ID NO: 1755 - RNA, 20 nt, Artificial Sequence
  spacer sequence
gucauuugaguuugcauagc

SEQ ID NO: 1756 - RNA, 20 nt, Artificial Sequence
  spacer sequence
uuugaguuugcauagcaaug

SEQ ID NO: 1757 - RNA, 20 nt, Artificial Sequence
  spacer sequence
aaugacugaagacucguuug

SEQ ID NO: 1758 - RNA, 20 nt, Artificial Sequence
  spacer sequence
gccucccacguucaagcacu

SEQ ID NO: 1759 - RNA, 20 nt, Artificial Sequence
  spacer sequence
cacguucaagcacuucuccu

SEQ ID NO: 1760 - RNA, 20 nt, Artificial Sequence
  spacer sequence
agcacuucuccugccucagc

SEQ ID NO: 1761 - RNA, 20 nt, Artificial Sequence
  spacer sequence
ccugccucagccucccaagu

SEQ ID NO: 1762 - RNA, 20 nt, Artificial Sequence
  spacer sequence
ugccucagccucccaaguag

SEQ ID NO: 1763 - RNA, 20 nt, Artificial Sequence
  spacer sequence
gccucccaaguagcugagau

SEQ ID NO: 1764 - RNA, 20 nt, Artificial Sequence
  spacer sequence
caaguagcugagauuacaga

SEQ ID NO: 1765 - RNA, 20 nt, Artificial Sequence
  spacer sequence
gcuacuugggaggcugaggc

SEQ ID NO: 1766 - RNA, 20 nt, Artificial Sequence
  spacer sequence
cagcuacuugggaggcugag

SEQ ID NO: 1767 - RNA, 20 nt, Artificial Sequence
  spacer sequence
guaaucucagcuacuuggga

SEQ ID NO: 1768 - RNA, 20 nt, Artificial Sequence
  spacer sequence
acuaaaaauacaaaaaguag

SEQ ID NO: 1769 - RNA, 20 nt, Artificial Sequence
  spacer sequence
cuacuaaaaauacaaaaagu

SEQ ID NO: 1770 - RNA, 20 nt, Artificial Sequence
  spacer sequence
ccauguugaccaggcugguc

SEQ ID NO: 1771 - RNA, 20 nt, Artificial Sequence
  spacer sequence
acauggugaaaccccaucuc

SEQ ID NO: 1772 - RNA, 20 nt, Artificial Sequence
  spacer sequence
ugaacuccugaccucaagug

SEQ ID NO: 1773 - RNA, 20 nt, Artificial Sequence
  spacer sequence
agaccagccuggucaacaug

SEQ ID NO: 1774 - RNA, 20 nt, Artificial Sequence
  spacer sequence
ugaccucaagugaggaggcc

SEQ ID NO: 1775 - RNA, 20 nt, Artificial Sequence
  spacer sequence
ggaguucaagaccagccugg

SEQ ID NO: 1776 - RNA, 20 nt, Artificial Sequence
  spacer sequence
uauaauaaauaauauucaca

SEQ ID NO: 1777 - RNA, 20 nt, Artificial Sequence
  spacer sequence
uagcagcugcuaccacagug

SEQ ID NO: 1778 - RNA, 20 nt, Artificial Sequence
  spacer sequence
gugauccuugccuccuugug

SEQ ID NO: 1779 - RNA, 20 nt, Artificial Sequence
  spacer sequence
cugagggccaucuuagcagc

SEQ ID NO: 1780 - RNA, 20 nt, Artificial Sequence
  spacer sequence
uugccuccuugugugaaaaa

SEQ ID NO: 1781 - RNA, 20 nt, Artificial Sequence
  spacer sequence
uugugugaaaaagggguuua

SEQ ID NO: 1782 - RNA, 20 nt, Artificial Sequence
  spacer sequence
cacaaggaggcaaggaucac

SEQ ID NO: 1783 - RNA, 20 nt, Artificial Sequence
  spacer sequence
guguguccccccccaguauu

SEQ ID NO: 1784 - RNA, 20 nt, Artificial Sequence
  spacer sequence
ccccccaguauuggcugacc

SEQ ID NO: 1785 - RNA, 20 nt, Artificial Sequence
  spacer sequence
gccaauacuggggggggaca

SEQ ID NO: 1786 - RNA, 20 nt, Artificial Sequence
  spacer sequence
ccacaauggucagccaauac

SEQ ID NO: 1787 - RNA, 20 nt, Artificial Sequence
  spacer sequence
auucaccacaauggucagcc

SEQ ID NO: 1788 - RNA, 20 nt, Artificial Sequence
  spacer sequence
gggaaaaugauagugugggg

SEQ ID NO: 1789 - RNA, 20 nt, Artificial Sequence
  spacer sequence
cagaauucuauucaccacaa

SEQ ID NO: 1790 - RNA, 20 nt, Artificial Sequence
  spacer sequence
uuuucccagaauucuauuca

SEQ ID NO: 1791 - RNA, 20 nt, Artificial Sequence
  spacer sequence
gccccacacuaucauuuucc

SEQ ID NO: 1792 - RNA, 20 nt, Artificial Sequence
  spacer sequence
gcucuguguccccacccaaa

SEQ ID NO: 1793 - RNA, 20 nt, Artificial Sequence
  spacer sequence
guguccccacccaaaucuca

SEQ ID NO: 1794 - RNA, 20 nt, Artificial Sequence
  spacer sequence
ccacccaaaucucaucucaa

SEQ ID NO: 1795 - RNA, 20 nt, Artificial Sequence
  spacer sequence
caucucaaauuguaaucccc

SEQ ID NO: 1796 - RNA, 20 nt, Artificial Sequence
  spacer sequence
ucucaaauuguaauccccau

SEQ ID NO: 1797 - RNA, 20 nt, Artificial Sequence
  spacer sequence
caaauuguaauccccauaug

SEQ ID NO: 1798 - RNA, 20 nt, Artificial Sequence
  spacer sequence
aauuguaauccccauauguc

SEQ ID NO: 1799 - RNA, 20 nt, Artificial Sequence
  spacer sequence
ccauaugucaagggagugac

SEQ ID NO: 1800 - RNA, 20 nt, Artificial Sequence
  spacer sequence
agggagugacuggaugggag

SEQ ID NO: 1801 - RNA, 20 nt, Artificial Sequence
  spacer sequence
cuugacauauggggauuaca

SEQ ID NO: 1802 - RNA, 20 nt, Artificial Sequence
  spacer sequence
cucccuugacauauggggau

SEQ ID NO: 1803 - RNA, 20 nt, Artificial Sequence
  spacer sequence
agucacucccuugacauaug

SEQ ID NO: 1804 - RNA, 20 nt, Artificial Sequence
  spacer sequence
cauccagucacucccuugac

SEQ ID NO: 1805 - RNA, 20 nt, Artificial Sequence
  spacer sequence
cucauccuguugucaugaua

SEQ ID NO: 1806 - RNA, 20 nt, Artificial Sequence
  spacer sequence
uccuguugucaugauaguga

SEQ ID NO: 1807 - RNA, 20 nt, Artificial Sequence
  spacer sequence
uguugucaugauagugagug

SEQ ID NO: 1808 - RNA, 20 nt, Artificial Sequence
  spacer sequence
ugauagugaguggcuucuca

SEQ ID NO: 1809 - RNA, 20 nt, Artificial Sequence
  spacer sequence
ugacaacaggaugagggaac

SEQ ID NO: 1810 - RNA, 20 nt, Artificial Sequence
  spacer sequence
cuaucaugacaacaggauga

SEQ ID NO: 1811 - RNA, 20 nt, Artificial Sequence
  spacer sequence
caugagaucugaugcuuuua

SEQ ID NO: 1812 - RNA, 20 nt, Artificial Sequence
  spacer sequence
ugagaucugaugcuuuuaga

SEQ ID NO: 1813 - RNA, 20 nt, Artificial Sequence
  spacer sequence
ugagaagccacucacuauca

SEQ ID NO: 1814 - RNA, 20 nt, Artificial Sequence
  spacer sequence
caugagaagccacucacuau

SEQ ID NO: 1815 - RNA, 20 nt, Artificial Sequence
  spacer sequence
gaugcuuuuagaaguguuug

SEQ ID NO: 1816 - RNA, 20 nt, Artificial Sequence
  spacer sequence
gaucucaugagaagccacuc

SEQ ID NO: 1817 - RNA, 20 nt, Artificial Sequence
  spacer sequence
aaaagcaucagaucucauga

SEQ ID NO: 1818 - RNA, 20 nt, Artificial Sequence
  spacer sequence
uccuucacuauuucucuuuu

SEQ ID NO: 1819 - RNA, 20 nt, Artificial Sequence
  spacer sequence
uucacuauuucucuuuuccu

SEQ ID NO: 1820 - RNA, 20 nt, Artificial Sequence
  spacer sequence
cuauuucucuuuuccugcca

SEQ ID NO: 1821 - RNA, 20 nt, Artificial Sequence
  spacer sequence
cuuuuccugccaccuuguga

SEQ ID NO: 1822 - RNA, 20 nt, Artificial Sequence
  spacer sequence
uuuccugccaccuugugaag

SEQ ID NO: 1823 - RNA, 20 nt, Artificial Sequence
  spacer sequence
ugccaccuugugaagaaaau

SEQ ID NO: 1824 - RNA, 20 nt, Artificial Sequence
  spacer sequence
caagguggcaggaaaagaga

SEQ ID NO: 1825 - RNA, 20 nt, Artificial Sequence
  spacer sequence
ucacaagguggcaggaaaag

SEQ ID NO: 1826 - RNA, 20 nt, Artificial Sequence
  spacer sequence
ccuuugccuuccaccaugau

SEQ ID NO: 1827 - RNA, 20 nt, Artificial Sequence
  spacer sequence
uuugccuuccaccaugauug

SEQ ID NO: 1828 - RNA, 20 nt, Artificial Sequence
  spacer sequence
accaugauuguaaguuuccu

SEQ ID NO: 1829 - RNA, 20 nt, Artificial Sequence
  spacer sequence
ugaggccuccccagccaugc

SEQ ID NO: 1830 - RNA, 20 nt, Artificial Sequence
  spacer sequence
ggaaacuuacaaucauggug

SEQ ID NO: 1831 - RNA, 20 nt, Artificial Sequence
  spacer sequence
ccagccaugcagccaugcaa

SEQ ID NO: 1832 - RNA, 20 nt, Artificial Sequence
  spacer sequence
uuccuuuauaaauuacccag

SEQ ID NO: 1833 - RNA, 20 nt, Artificial Sequence
  spacer sequence
uuuauaaauuacccagucuc

SEQ ID NO: 1834 - RNA, 20 nt, Artificial Sequence
  spacer sequence
caaguauuucuuuauagcag

SEQ ID NO: 1835 - RNA, 20 nt, Artificial Sequence
  spacer sequence
aguauuucuuuauagcagug

SEQ ID NO: 1836 - RNA, 20 nt, Artificial Sequence
  spacer sequence
uuauagcagugugaaaaugg

SEQ ID NO: 1837 - RNA, 20 nt, Artificial Sequence
  spacer sequence
cacugcuauaaagaaauacu

SEQ ID NO: 1838 - RNA, 20 nt, Artificial Sequence
  spacer sequence
auuuucacacugcuauaaag

SEQ ID NO: 1839 - RNA, 20 nt, Artificial Sequence
  spacer sequence
guauuaguccauuuucacac

SEQ ID NO: 1840 - RNA, 20 nt, Artificial Sequence
  spacer sequence
agggcuaagucaucaaagac

SEQ ID NO: 1841 - RNA, 20 nt, Artificial Sequence
  spacer sequence
ucaaagacauuguggcuucc

SEQ ID NO: 1842 - RNA, 20 nt, Artificial Sequence
  spacer sequence
aagacauuguggcuuccguc

SEQ ID NO: 1843 - RNA, 20 nt, Artificial Sequence
  spacer sequence
uugaugacuuagcccuggaa

SEQ ID NO: 1844 - RNA, 20 nt, Artificial Sequence
  spacer sequence
gucuugcucucuuggauuac

SEQ ID NO: 1845 - RNA, 20 nt, Artificial Sequence
  spacer sequence
ugcucucuuggauuacucau

SEQ ID NO: 1846 - RNA, 20 nt, Artificial Sequence
  spacer sequence
cuuggauuacucauucugag

SEQ ID NO: 1847 - RNA, 20 nt, Artificial Sequence
  spacer sequence
uggauuacucauucugaggg

SEQ ID NO: 1848 - RNA, 20 nt, Artificial Sequence
  spacer sequence
aagagagcaagacggaagcc

SEQ ID NO: 1849 - RNA, 20 nt, Artificial Sequence
  spacer sequence
uucugagggaagccagcugc

SEQ ID NO: 1850 - RNA, 20 nt, Artificial Sequence
  spacer sequence
gagggaagccagcugccaug

SEQ ID NO: 1851 - RNA, 20 nt, Artificial Sequence
  spacer sequence
gaaugaguaauccaagagag

SEQ ID NO: 1852 - RNA, 20 nt, Artificial Sequence
  spacer sequence
cucagaaugaguaauccaag

SEQ ID NO: 1853 - RNA, 20 nt, Artificial Sequence
  spacer sequence
gugcaccuucugagaggcuc

SEQ ID NO: 1854 - RNA, 20 nt, Artificial Sequence
  spacer sequence
gagaggcucaugcagagagg

SEQ ID NO: 1855 - RNA, 20 nt, Artificial Sequence
  spacer sequence
gaaggugcacugaguggccu

SEQ ID NO: 1856 - RNA, 20 nt, Artificial Sequence
  spacer sequence
cagaaggugcacugaguggc

SEQ ID NO: 1857 - RNA, 20 nt, Artificial Sequence
  spacer sequence
ugcagagaggaccugaggcc

SEQ ID NO: 1858 - RNA, 20 nt, Artificial Sequence
  spacer sequence
gcaugagccucucagaaggu

SEQ ID NO: 1859 - RNA, 20 nt, Artificial Sequence
  spacer sequence
cugcaugagccucucagaag

SEQ ID NO: 1860 - RNA, 20 nt, Artificial Sequence
  spacer sequence
ucucugcaugagccucucag

SEQ ID NO: 1861 - RNA, 20 nt, Artificial Sequence
  spacer sequence
gguccucucugcaugagccu

SEQ ID NO: 1862 - RNA, 20 nt, Artificial Sequence
  spacer sequence
caucaacagccagcaccaaa

SEQ ID NO: 1863 - RNA, 20 nt, Artificial Sequence
  spacer sequence
acagccagcaccaaaauacc

SEQ ID NO: 1864 - RNA, 20 nt, Artificial Sequence
  spacer sequence
uuuauaaaaccccuuacauu

SEQ ID NO: 1865 - RNA, 20 nt, Artificial Sequence
  spacer sequence
agcucauuuauaaaaccccu

SEQ ID NO: 1866 - RNA, 20 nt, Artificial Sequence
  spacer sequence
ucaagcucauuuauaaaacc

SEQ ID NO: 1867 - RNA, 20 nt, Artificial Sequence
  spacer sequence
gauuuacauagggcaugaaa

SEQ ID NO: 1868 - RNA, 20 nt, Artificial Sequence
  spacer sequence
gacagcgccuccucaagcuc

SEQ ID NO: 1869 - RNA, 20 nt, Artificial Sequence
  spacer sequence
ugcccuauguaaaucagaca

SEQ ID NO: 1870 - RNA, 20 nt, Artificial Sequence
  spacer sequence
uucaugcccuauguaaauca

SEQ ID NO: 1871 - RNA, 20 nt, Artificial Sequence
  spacer sequence
aaccaaucuuucaugcccua

SEQ ID NO: 1872 - RNA, 20 nt, Artificial Sequence
  spacer sequence
uuuauuaugcagauauguuc

SEQ ID NO: 1873 - RNA, 20 nt, Artificial Sequence
  spacer sequence
gcauaauaaaagauuagggu

SEQ ID NO: 1874 - RNA, 20 nt, Artificial Sequence
  spacer sequence
cuggccugcgccauguugcc

SEQ ID NO: 1875 - RNA, 20 nt, Artificial Sequence
  spacer sequence
ggccugcgccauguugccug

SEQ ID NO: 1876 - RNA, 20 nt, Artificial Sequence
  spacer sequence
gggaaaguaaaaugcucacu

SEQ ID NO: 1877 - RNA, 20 nt, Artificial Sequence
  spacer sequence
cuaucagggaaaguaaaaug

SEQ ID NO: 1878 - RNA, 20 nt, Artificial Sequence
  spacer sequence
uucacuaucagggaaaguaa

SEQ ID NO: 1879 - RNA, 20 nt, Artificial Sequence
  spacer sequence
uuccuuuuucuuccuauuug

SEQ ID NO: 1880 - RNA, 20 nt, Artificial Sequence
  spacer sequence
uuuuucuuccuauuuguucu

SEQ ID NO: 1881 - RNA, 20 nt, Artificial Sequence
  spacer sequence
uccuauuuguucuuuggugu

SEQ ID NO: 1882 - RNA, 20 nt, Artificial Sequence
  spacer sequence
uauuuguucuuuggugucac

SEQ ID NO: 1883 - RNA, 20 nt, Artificial Sequence
  spacer sequence
uuggugucacucugauucau

SEQ ID NO: 1884 - RNA, 20 nt, Artificial Sequence
  spacer sequence
cucugauucauggauucuug

SEQ ID NO: 1885 - RNA, 20 nt, Artificial Sequence
  spacer sequence
gauucauggauucuuguuuu

SEQ ID NO: 1886 - RNA, 20 nt, Artificial Sequence
  spacer sequence
gagugacaccaaagaacaaa

SEQ ID NO: 1887 - RNA, 20 nt, Artificial Sequence
  spacer sequence
uggauucuuguuuuaaucaa

SEQ ID NO: 1888 - RNA, 20 nt, Artificial Sequence
  spacer sequence
augaaucagagugacaccaa

SEQ ID NO: 1889 - RNA, 20 nt, Artificial Sequence
  spacer sequence
uguuuuaaucaaauguaaua

SEQ ID NO: 1890 - RNA, 20 nt, Artificial Sequence
  spacer sequence
aauguaauauuauaccgaua

SEQ ID NO: 1891 - RNA, 20 nt, Artificial Sequence
  spacer sequence
ggauaucacucugugucagu

SEQ ID NO: 1892 - RNA, 20 nt, Artificial Sequence
  spacer sequence
agaauauauuguuagguuaa

SEQ ID NO: 1893 - RNA, 20 nt, Artificial Sequence
  spacer sequence
cucugugucaguucauagag

SEQ ID NO: 1894 - RNA, 20 nt, Artificial Sequence
  spacer sequence
gugucaguucauagagaucu

SEQ ID NO: 1895 - RNA, 20 nt, Artificial Sequence
  spacer sequence
guucauagagaucuucauug

SEQ ID NO: 1896 - RNA, 20 nt, Artificial Sequence
  spacer sequence
uagagaucuucauuguugcu

SEQ ID NO: 1897 - RNA, 20 nt, Artificial Sequence
  spacer sequence
augaacugacacagagugau

SEQ ID NO: 1898 - RNA, 20 nt, Artificial Sequence
  spacer sequence
cuaugaacugacacagagug

SEQ ID NO: 1899 - RNA, 20 nt, Artificial Sequence
  spacer sequence
ucauuguugcuuuuuacagu

SEQ ID NO: 1900 - RNA, 20 nt, Artificial Sequence
  spacer sequence
uuguugcuuuuuacagugac

SEQ ID NO: 1901 - RNA, 20 nt, Artificial Sequence
  spacer sequence
cuguaaaaagcaacaaugaa

SEQ ID NO: 1902 - RNA, 20 nt, Artificial Sequence
  spacer sequence
auuauguagacauaccauaa

SEQ ID NO: 1903 - RNA, 20 nt, Artificial Sequence
  spacer sequence
acauaauggaauaccauguc

SEQ ID NO: 1904 - RNA, 20 nt, Artificial Sequence
  spacer sequence
aacaauuucuuacauaugga

SEQ ID NO: 1905 - RNA, 20 nt, Artificial Sequence
  spacer sequence
uacauauggacauugagguu

SEQ ID NO: 1906 - RNA, 20 nt, Artificial Sequence
  spacer sequence
auauguaagaaauuguuuga

SEQ ID NO: 1907 - RNA, 20 nt, Artificial Sequence
  spacer sequence
auguccauauguaagaaauu

SEQ ID NO: 1908 - RNA, 20 nt, Artificial Sequence
  spacer sequence
agcauaauuuguaauugcaa

SEQ ID NO: 1909 - RNA, 20 nt, Artificial Sequence
  spacer sequence
gaugggcaauaggugcauug

SEQ ID NO: 1910 - RNA, 20 nt, Artificial Sequence
  spacer sequence
gaauggcaaaaacucaaaau

SEQ ID NO: 1911 - RNA, 20 nt, Artificial Sequence
  spacer sequence
guuuauauuauuauguaacu

SEQ ID NO: 1912 - RNA, 20 nt, Artificial Sequence
  spacer sequence
aguuacauaauaauauaaac

SEQ ID NO: 1913 - RNA, 20 nt, Artificial Sequence
  spacer sequence
cccaccaugugagugguucc

SEQ ID NO: 1914 - RNA, 20 nt, Artificial Sequence
  spacer sequence
cauggugggugaaugcaagc

SEQ ID NO: 1915 - RNA, 20 nt, Artificial Sequence
  spacer sequence
uaagacuuuaauuuugagaa

SEQ ID NO: 1916 - RNA, 20 nt, Artificial Sequence
  spacer sequence
uaggaaccacucacauggug

SEQ ID NO: 1917 - RNA, 20 nt, Artificial Sequence
  spacer sequence
aaauuaaagucuuaggaacc

SEQ ID NO: 1918 - RNA, 20 nt, Artificial Sequence
  spacer sequence
caaaauuaaagucuuaggaa

SEQ ID NO: 1919 - RNA, 20 nt, Artificial Sequence
  spacer sequence
acucaggcuccagguccuua

SEQ ID NO: 1920 - RNA, 20 nt, Artificial Sequence
  spacer sequence
ggcuccagguccuuauucuu

SEQ ID NO: 1921 - RNA, 20 nt, Artificial Sequence
  spacer sequence
agguccuuauucuucagccc

SEQ ID NO: 1922 - RNA, 20 nt, Artificial Sequence
  spacer sequence
uuauucuucagccccgaccc

SEQ ID NO: 1923 - RNA, 20 nt, Artificial Sequence
  spacer sequence
ucagccccgaccccucuuuc

SEQ ID NO: 1924 - RNA, 20 nt, Artificial Sequence
  spacer sequence
gccccgaccccucuuuccuc

SEQ ID NO: 1925 - RNA, 20 nt, Artificial Sequence
  spacer sequence
gggcugaagaauaaggaccu

SEQ ID NO: 1926 - RNA, 20 nt, Artificial Sequence
  spacer sequence
uuccucccuguagacacuuc

SEQ ID NO: 1927 - RNA, 20 nt, Artificial Sequence
  spacer sequence
ucccuguagacacuuccuuc

SEQ ID NO: 1928 - RNA, 20 nt, Artificial Sequence
  spacer sequence
cuguagacacuuccuuccau

SEQ ID NO: 1929 - RNA, 20 nt, Artificial Sequence
  spacer sequence
acagggaggaaagagggguc

SEQ ID NO: 1930 - RNA, 20 nt, Artificial Sequence
  spacer sequence
uuccaucuaaaccgccacgg

SEQ ID NO: 1931 - RNA, 20 nt, Artificial Sequence
  spacer sequence
aucuaaaccgccacggcagc

SEQ ID NO: 1932 - RNA, 20 nt, Artificial Sequence
  spacer sequence
aaaccgccacggcagccucc

SEQ ID NO: 1933 - RNA, 20 nt, Artificial Sequence
  spacer sequence
uucagcacacagauaacauc

SEQ ID NO: 1934 - RNA, 20 nt, Artificial Sequence
  spacer sequence
gcacacagauaacauccucc

SEQ ID NO: 1935 - RNA, 20 nt, Artificial Sequence
  spacer sequence
gugugcugaaggaggcugcc

SEQ ID NO: 1936 - RNA, 20 nt, Artificial Sequence
  spacer sequence
uccucacugagugggcagga

SEQ ID NO: 1937 - RNA, 20 nt, Artificial Sequence
  spacer sequence
ucacugagugggcaggaaag

SEQ ID NO: 1938 - RNA, 20 nt, Artificial Sequence
  spacer sequence
cugagugggcaggaaaggag

SEQ ID NO: 1939 - RNA, 20 nt, Artificial Sequence
  spacer sequence
gugaggaggauguuaucugu

SEQ ID NO: 1940 - RNA, 20 nt, Artificial Sequence
  spacer sequence
ugcccacucagugaggagga

SEQ ID NO: 1941 - RNA, 20 nt, Artificial Sequence
  spacer sequence
uuuccugcccacucagugag

SEQ ID NO: 1942 - RNA, 20 nt, Artificial Sequence
  spacer sequence
aagaaugaagugguuuaccc

SEQ ID NO: 1943 - RNA, 20 nt, Artificial Sequence
  spacer sequence
uugaaccuccuuuccugccc

SEQ ID NO: 1944 - RNA, 20 nt, Artificial Sequence
  spacer sequence
uucuuugaaccuccuuuccu

SEQ ID NO: 1945 - RNA, 20 nt, Artificial Sequence
  spacer sequence
auuuacuggcuggguaaacc

SEQ ID NO: 1946 - RNA, 20 nt, Artificial Sequence
  spacer sequence
ccauuuacuggcuggguaaa

SEQ ID NO: 1947 - RNA, 20 nt, Artificial Sequence
  spacer sequence
aagacuagagaccaucuguu

SEQ ID NO: 1948 - RNA, 20 nt, Artificial Sequence
  spacer sequence
uggauucuccauuuacuggc

SEQ ID NO: 1949 - RNA, 20 nt, Artificial Sequence
  spacer sequence
agucuuggauucuccauuua

SEQ ID NO: 1950 - RNA, 20 nt, Artificial Sequence
  spacer sequence
cuagucuuggauucuccauu

SEQ ID NO: 1951 - RNA, 20 nt, Artificial Sequence
  spacer sequence
guucauuuuuguuuguuugc

SEQ ID NO: 1952 - RNA, 20 nt, Artificial Sequence
  spacer sequence
uuuuuguuuguuugcauuuu

SEQ ID NO: 1953 - RNA, 20 nt, Artificial Sequence
  spacer sequence
uuucuuuucuuuauucuuuc

SEQ ID NO: 1954 - RNA, 20 nt, Artificial Sequence
  spacer sequence
uuucuuuauucuuucuuucu

SEQ ID NO: 1955 - RNA, 20 nt, Artificial Sequence
  spacer sequence
uuauucuuucuuucuuuuuc

SEQ ID NO: 1956 - RNA, 20 nt, Artificial Sequence
  spacer sequence
uucuuucuuuuucauuuccu

SEQ ID NO: 1957 - RNA, 20 nt, Artificial Sequence
  spacer sequence
uucuuuuucauuuccuuucu

SEQ ID NO: 1958 - RNA, 20 nt, Artificial Sequence
  spacer sequence
uuuucauuuccuuucuuccu

SEQ ID NO: 1959 - RNA, 20 nt, Artificial Sequence
  spacer sequence
uuuccuuucuuccuuccuuu

SEQ ID NO: 1960 - RNA, 20 nt, Artificial Sequence
  spacer sequence
uuucuuccuuccuuuucuuc

SEQ ID NO: 1961 - RNA, 20 nt, Artificial Sequence
  spacer sequence
uccuuccuuuucuuccuucc

SEQ ID NO: 1962 - RNA, 20 nt, Artificial Sequence
  spacer sequence
uuccuuuucuuccuuccucu

SEQ ID NO: 1963 - RNA, 20 nt, Artificial Sequence
  spacer sequence
uuuucuuccuuccucuuucu

SEQ ID NO: 1964 - RNA, 20 nt, Artificial Sequence
  spacer sequence
uccuuccucuuucuuuuuuu

SEQ ID NO: 1965 - RNA, 20 nt, Artificial Sequence
  spacer sequence
uuccucuuucuuuuuuucuu

SEQ ID NO: 1966 - RNA, 20 nt, Artificial Sequence
  spacer sequence
ucuuucuuuuuuucuuucuu

SEQ ID NO: 1967 - RNA, 20 nt, Artificial Sequence
  spacer sequence
uucuuuuuuucuuucuucuu

SEQ ID NO: 1968 - RNA, 20 nt, Artificial Sequence
  spacer sequence
uuuuuucuuucuucuuucuc

SEQ ID NO: 1969 - RNA, 20 nt, Artificial Sequence
  spacer sequence
uucuucuuucucuucuuucu

SEQ ID NO: 1970 - RNA, 20 nt, Artificial Sequence
  spacer sequence
ucuuucucuucuuucucuuu

SEQ ID NO: 1971 - RNA, 20 nt, Artificial Sequence
  spacer sequence
uucucuucuuucucuuucuu

SEQ ID NO: 1972 - RNA, 20 nt, Artificial Sequence
  spacer sequence
cuucuuucucuuucuuuucu

SEQ ID NO: 1973 - RNA, 20 nt, Artificial Sequence
  spacer sequence
ucuuucucuuucuuuucuug

SEQ ID NO: 1974 - RNA, 20 nt, Artificial Sequence
  spacer sequence
uucucuuucuuuucuugcuc

SEQ ID NO: 1975 - RNA, 20 nt, Artificial Sequence
  spacer sequence
cuuucuuuucuugcucucuu

SEQ ID NO: 1976 - RNA, 20 nt, Artificial Sequence
  spacer sequence
uucuuuucuugcucucuuuc

SEQ ID NO: 1977 - RNA, 20 nt, Artificial Sequence
  spacer sequence
uuucuugcucucuuucuucu

SEQ ID NO: 1978 - RNA, 20 nt, Artificial Sequence
  spacer sequence
ugcucucuuucuucuuucuu

SEQ ID NO: 1979 - RNA, 20 nt, Artificial Sequence
  spacer sequence
cuuucuucuuucuuguuguu

SEQ ID NO: 1980 - RNA, 20 nt, Artificial Sequence
  spacer sequence
uucuucuuucuuguuguugu

SEQ ID NO: 1981 - RNA, 20 nt, Artificial Sequence
  spacer sequence
ucuuucuuguuguuguuuuu

SEQ ID NO: 1982 - RNA, 20 nt, Artificial Sequence
  spacer sequence
uucuuguuguuguuuuuguu

SEQ ID NO: 1983 - RNA, 20 nt, Artificial Sequence
  spacer sequence
uguuguuguuuuuguugaga

SEQ ID NO: 1984 - RNA, 20 nt, Artificial Sequence
  spacer sequence
acaaaaacaacaacaagaaa

SEQ ID NO: 1985 - RNA, 20 nt, Artificial Sequence
  spacer sequence
caacaaaaacaacaacaaga

SEQ ID NO: 1986 - RNA, 20 nt, Artificial Sequence
  spacer sequence
ugugcucagauuccuaguac

SEQ ID NO: 1987 - RNA, 20 nt, Artificial Sequence
  spacer sequence
gauuccuaguacaugacuau

SEQ ID NO: 1988 - RNA, 20 nt, Artificial Sequence
  spacer sequence
gagcacaugaucucaacaaa

SEQ ID NO: 1989 - RNA, 20 nt, Artificial Sequence
  spacer sequence
uaguacaugacuauaaaguu

SEQ ID NO: 1990 - RNA, 20 nt, Artificial Sequence
  spacer sequence
uguacuaggaaucugagcac

SEQ ID NO: 1991 - RNA, 20 nt, Artificial Sequence
  spacer sequence
uaacuuuauagucauguacu

SEQ ID NO: 1992 - RNA, 20 nt, Artificial Sequence
  spacer sequence
uuccuaacuuuauagucaug

SEQ ID NO: 1993 - RNA, 20 nt, Artificial Sequence
  spacer sequence
ugggggcucuuuccuaacuu

SEQ ID NO: 1994 - RNA, 20 nt, Artificial Sequence
  spacer sequence
ccucugauaccaauuuaaag

SEQ ID NO: 1995 - RNA, 20 nt, Artificial Sequence
  spacer sequence
gauaccaauuuaaaguuuag

SEQ ID NO: 1996 - RNA, 20 nt, Artificial Sequence
  spacer sequence
gaggggaaaguggucuuggg

SEQ ID NO: 1997 - RNA, 20 nt, Artificial Sequence
  spacer sequence
ccacaaccaccuucaaguuc

SEQ ID NO: 1998 - RNA, 20 nt, Artificial Sequence
  spacer sequence
aguucaauaauccacuuggu

SEQ ID NO: 1999 - RNA, 20 nt, Artificial Sequence
  spacer sequence
auaauccacuugguggacuc

SEQ ID NO: 2000 - RNA, 20 nt, Artificial Sequence
  spacer sequence
acuugguggacucgcagaac

SEQ ID NO: 2001 - RNA, 20 nt, Artificial Sequence
  spacer sequence
accaaguggauuauugaacu

SEQ ID NO: 2002 - RNA, 20 nt, Artificial Sequence
  spacer sequence
cagaacguacugaaagcuau

SEQ ID NO: 2003 - RNA, 20 nt, Artificial Sequence
  spacer sequence
gcgaguccaccaaguggauu

SEQ ID NO: 2004 - RNA, 20 nt, Artificial Sequence
  spacer sequence
guacguucugcgaguccacc

SEQ ID NO: 2005 - RNA, 20 nt, Artificial Sequence
  spacer sequence
uagcaaaaggacacagauua

SEQ ID NO: 2006 - RNA, 20 nt, Artificial Sequence
  spacer sequence
uuuugcuaugauaaacugua

SEQ ID NO: 2007 - RNA, 20 nt, Artificial Sequence
  spacer sequence
guguccuuuugcuaugauaa

SEQ ID NO: 2008 - RNA, 20 nt, Artificial Sequence
  spacer sequence
gccaagggaagacacacaua

SEQ ID NO: 2009 - RNA, 20 nt, Artificial Sequence
  spacer sequence
cuuggcugauguuaaucugu

SEQ ID NO: 2010 - RNA, 20 nt, Artificial Sequence
  spacer sequence
ucccuuggcugauguuaauc

SEQ ID NO: 2011 - RNA, 20 nt, Artificial Sequence
  spacer sequence
aggagagcuuccagcagucc

SEQ ID NO: 2012 - RNA, 20 nt, Artificial Sequence
  spacer sequence
uggacacugcccuaugugug

SEQ ID NO: 2013 - RNA, 20 nt, Artificial Sequence
  spacer sequence
ccuggacacugcccuaugug

SEQ ID NO: 2014 - RNA, 20 nt, Artificial Sequence
  spacer sequence
agcaguccucucccagugga

SEQ ID NO: 2015 - RNA, 20 nt, Artificial Sequence
  spacer sequence
ucucccaguggaguaaugga

SEQ ID NO: 2016 - RNA, 20 nt, Artificial Sequence
  spacer sequence
cccaguggaguaauggacuc

SEQ ID NO: 2017 - RNA, 20 nt, Artificial Sequence
  spacer sequence
caguggaguaauggacuccu

SEQ ID NO: 2018 - RNA, 20 nt, Artificial Sequence
  spacer sequence
acugggagaggacugcugga

SEQ ID NO: 2019 - RNA, 20 nt, Artificial Sequence
  spacer sequence
auuacuccacugggagagga

SEQ ID NO: 2020 - RNA, 20 nt, Artificial Sequence
  spacer sequence
uucuggaaacuauaugcacg

SEQ ID NO: 2021 - RNA, 20 nt, Artificial Sequence
  spacer sequence
ggaaacuauaugcacggacu

SEQ ID NO: 2022 - RNA, 20 nt, Artificial Sequence
  spacer sequence
agaaggaguccauuacucca

SEQ ID NO: 2023 - RNA, 20 nt, Artificial Sequence
  spacer sequence
gugcauauaguuuccagaag

SEQ ID NO: 2024 - RNA, 20 nt, Artificial Sequence
  spacer sequence
auguauauaguccgugcaua

SEQ ID NO: 2025 - RNA, 20 nt, Artificial Sequence
  spacer sequence
uugguuggcaauacuccaug

SEQ ID NO: 2026 - RNA, 20 nt, Artificial Sequence
  spacer sequence
ccaggcuguugguguccaga

SEQ ID NO: 2027 - RNA, 20 nt, Artificial Sequence
  spacer sequence
cccaccauaaaucacauugg

SEQ ID NO: 2028 - RNA, 20 nt, Artificial Sequence
  spacer sequence
caccauaaaucacauugguc

SEQ ID NO: 2029 - RNA, 20 nt, Artificial Sequence
  spacer sequence
cauuggucuaacauguugug

SEQ ID NO: 2030 - RNA, 20 nt, Artificial Sequence
  spacer sequence
aacauguugugucuguuugg

SEQ ID NO: 2031 - RNA, 20 nt, Artificial Sequence
  spacer sequence
guuuggcauggcccauggcc

SEQ ID NO: 2032 - RNA, 20 nt, Artificial Sequence
  spacer sequence
agguaaacacagugcuauua

SEQ ID NO: 2033 - RNA, 20 nt, Artificial Sequence
  spacer sequence
agcaggacaucuaagggcuu

SEQ ID NO: 2034 - RNA, 20 nt, Artificial Sequence
  spacer sequence
ugcuugauaauagcacugug

SEQ ID NO: 2035 - RNA, 20 nt, Artificial Sequence
  spacer sequence
aagggcuuagagaucaccuc

SEQ ID NO: 2036 - RNA, 20 nt, Artificial Sequence
  spacer sequence
aagcccuuagauguccugcu

SEQ ID NO: 2037 - RNA, 20 nt, Artificial Sequence
  spacer sequence
cuaagcccuuagauguccug

SEQ ID NO: 2038 - RNA, 20 nt, Artificial Sequence
  spacer sequence
ccucccaagagccaagggca

SEQ ID NO: 2039 - RNA, 20 nt, Artificial Sequence
  spacer sequence
caagagccaagggcaaagcc

SEQ ID NO: 2040 - RNA, 20 nt, Artificial Sequence
  spacer sequence
ugggaggugaucucuaagcc

SEQ ID NO: 2041 - RNA, 20 nt, Artificial Sequence
  spacer sequence
gggcuuugcccuuggcucuu

SEQ ID NO: 2042 - RNA, 20 nt, Artificial Sequence
  spacer sequence
cacuucaaguaagcuuaaaa

SEQ ID NO: 2043 - RNA, 20 nt, Artificial Sequence
  spacer sequence
cuucaaguaagcuuaaaauu

SEQ ID NO: 2044 - RNA, 20 nt, Artificial Sequence
  spacer sequence
aguaagcuuaaaauucuuua

SEQ ID NO: 2045 - RNA, 20 nt, Artificial Sequence
  spacer sequence
uuacuacacaacacccuuuc

SEQ ID NO: 2046 - RNA, 20 nt, Artificial Sequence
  spacer sequence
uuguuacaggagaguggggg

SEQ ID NO: 2047 - RNA, 20 nt, Artificial Sequence
  spacer sequence
uguaacaaggaaaggguguu

SEQ ID NO: 2048 - RNA, 20 nt, Artificial Sequence
  spacer sequence
ccuguaacaaggaaagggug

SEQ ID NO: 2049 - RNA, 20 nt, Artificial Sequence
  spacer sequence
cagaggaagagcucauaacu

SEQ ID NO: 2050 - RNA, 20 nt, Artificial Sequence
  spacer sequence
gugagggccagcagggcacc

SEQ ID NO: 2051 - RNA, 20 nt, Artificial Sequence
  spacer sequence
ucugugagggccagcagggc

SEQ ID NO: 2052 - RNA, 20 nt, Artificial Sequence
  spacer sequence
uccucugugagggccagcag

SEQ ID NO: 2053 - RNA, 20 nt, Artificial Sequence
  spacer sequence
uaacucauaacccacaaaac

SEQ ID NO: 2054 - RNA, 20 nt, Artificial Sequence
  spacer sequence
uaacccacaaaacuguaaug

SEQ ID NO: 2055 - RNA, 20 nt, Artificial Sequence
  spacer sequence
uuacaguuuuguggguuaug

SEQ ID NO: 2056 - RNA, 20 nt, Artificial Sequence
  spacer sequence
cauccgacugaaaaauggga

SEQ ID NO: 2057 - RNA, 20 nt, Artificial Sequence
  spacer sequence
gacugaaaaaugggacugga

SEQ ID NO: 2058 - RNA, 20 nt, Artificial Sequence
  spacer sequence
gaugggauugcccuucauua

SEQ ID NO: 2059 - RNA, 20 nt, Artificial Sequence
  spacer sequence
gucggaugggauugcccuuc

SEQ ID NO: 2060 - RNA, 20 nt, Artificial Sequence
  spacer sequence
cauuuuucagucggauggga

SEQ ID NO: 2061 - RNA, 20 nt, Artificial Sequence
  spacer sequence
agucccauuuuucagucgga

SEQ ID NO: 2062 - RNA, 20 nt, Artificial Sequence
  spacer sequence
gugccuguuuccagucccau

SEQ ID NO: 2063 - RNA, 20 nt, Artificial Sequence
  spacer sequence
agaaggaaagagaggggcac

SEQ ID NO: 2064 - RNA, 20 nt, Artificial Sequence
  spacer sequence
ggaauguucagugccuguuu

SEQ ID NO: 2065 - RNA, 20 nt, Artificial Sequence
  spacer sequence
uucuggaauguucagugccu

SEQ ID NO: 2066 - RNA, 20 nt, Artificial Sequence
  spacer sequence
uuccuucuggaauguucagu

SEQ ID NO: 2067 - RNA, 20 nt, Artificial Sequence
  spacer sequence
cuuuccuucuggaauguuca

SEQ ID NO: 2068 - RNA, 20 nt, Artificial Sequence
  spacer sequence
ccugugccccucucuuuccu

SEQ ID NO: 2069 - RNA, 20 nt, Artificial Sequence
  spacer sequence
acuuacgcgcuccccugugc

SEQ ID NO: 2070 - RNA, 20 nt, Artificial Sequence
  spacer sequence
uuaaauccacuuacgcgcuc

SEQ ID NO: 2071 - RNA, 20 nt, Artificial Sequence
  spacer sequence
acaagaaaaagugcaaucga

SEQ ID NO: 2072 - RNA, 20 nt, Artificial Sequence
  spacer sequence
uguagacuagccaucauuaa

SEQ ID NO: 2073 - RNA, 20 nt, Artificial Sequence
  spacer sequence
auucagguuauugaaaauuc

SEQ ID NO: 2074 - RNA, 20 nt, Artificial Sequence
  spacer sequence
auugcacuuuuucuuguaga

SEQ ID NO: 2075 - RNA, 20 nt, Artificial Sequence
  spacer sequence
gguuauugaaaauucacccc

SEQ ID NO: 2076 - RNA, 20 nt, Artificial Sequence
  spacer sequence
auaaccugaaucgauugcac

SEQ ID NO: 2077 - RNA, 20 nt, Artificial Sequence
  spacer sequence
cccccaauauuuuccucuac

SEQ ID NO: 2078 - RNA, 20 nt, Artificial Sequence
  spacer sequence
ucuacucaucaaacguggaa

SEQ ID NO: 2079 - RNA, 20 nt, Artificial Sequence
  spacer sequence
acucaucaaacguggaagaa

SEQ ID NO: 2080 - RNA, 20 nt, Artificial Sequence
  spacer sequence
ucaaacguggaagaaagggg

SEQ ID NO: 2081 - RNA, 20 nt, Artificial Sequence
  spacer sequence
aacguggaagaaaggggcuc

SEQ ID NO: 2082 - RNA, 20 nt, Artificial Sequence
  spacer sequence
acguuugaugaguagaggaa

SEQ ID NO: 2083 - RNA, 20 nt, Artificial Sequence
  spacer sequence
uccacguuugaugaguagag

SEQ ID NO: 2084 - RNA, 20 nt, Artificial Sequence
  spacer sequence
uuggagcuugcucauggcuc

SEQ ID NO: 2085 - RNA, 20 nt, Artificial Sequence
  spacer sequence
aaugagccccuuucuuccac

SEQ ID NO: 2086 - RNA, 20 nt, Artificial Sequence
  spacer sequence
uggcucgcaucagggccagc

SEQ ID NO: 2087 - RNA, 20 nt, Artificial Sequence
  spacer sequence
caucagggccagccggccug

SEQ ID NO: 2088 - RNA, 20 nt, Artificial Sequence
  spacer sequence
gggccagccggccugucuug

SEQ ID NO: 2089 - RNA, 20 nt, Artificial Sequence
  spacer sequence
uguucucugauuauaacauc

SEQ ID NO: 2090 - RNA, 20 nt, Artificial Sequence
  spacer sequence
cugauuauaacaucaaggac

SEQ ID NO: 2091 - RNA, 20 nt, Artificial Sequence
  spacer sequence
gauuauaacaucaaggaccc

SEQ ID NO: 2092 - RNA, 20 nt, Artificial Sequence
  spacer sequence
gagaacaagacaggccggcu

SEQ ID NO: 2093 - RNA, 20 nt, Artificial Sequence
  spacer sequence
aggaccccuagguggugcug

SEQ ID NO: 2094 - RNA, 20 nt, Artificial Sequence
  spacer sequence
uugauguuauaaucagagaa

SEQ ID NO: 2095 - RNA, 20 nt, Artificial Sequence
  spacer sequence
gcaccaccuagggguccuug

SEQ ID NO: 2096 - RNA, 20 nt, Artificial Sequence
  spacer sequence
agcuuggguggcaaauaguu

SEQ ID NO: 2097 - RNA, 20 nt, Artificial Sequence
  spacer sequence
uuuuuuguuguuguuaacua

SEQ ID NO: 2098 - RNA, 20 nt, Artificial Sequence
  spacer sequence
gaaaguucagcaaaccucuu

SEQ ID NO: 2099 - RNA, 20 nt, Artificial Sequence
  spacer sequence
gauuccuuuuuuguuguugu

SEQ ID NO: 2100 - RNA, 20 nt, Artificial Sequence
  spacer sequence
gcaaaccucuucuuuuuuuu

SEQ ID NO: 2101 - RNA, 108 nt, Artificial Sequence
  gNA Variant Scaffold
uacuggcgcuuuuaucucauuacuuugagagccaucaccagcgacuaugucguauggguaaagcgcaggugggacgaccucucggucguccuaucugaagcaucaaag

SEQ ID NO: 2102 - RNA, 99 nt, Artificial Sequence
  gNA Variant Scaffold
uacuggcgcuuuuaucucauuacuuugagagccaucaccagcgacuaugucguauggguaaagcgcugcucgacgcguccucgagcagaagcaucaaag

SEQ ID NO: 2103 - RNA, 97 nt, Artificial Sequence
  gNA Variant Scaffold
uacuggcgcuuuuaucucauuacuuugagagccaucaccagcgacuaugucguauggguaaagcgcugcucgcuccguucgagcagaagcaucaaag

SEQ ID NO: 2104 - RNA, 91 nt, Artificial Sequence
  gNA Variant Scaffold
guacuggcgcuuuuaucucauuacuuugagagccaucaccagcgacuaugucguauggguaaagcgcccucuucggagggaagcaucaaag

SEQ ID NO: 2105 - RNA, 99 nt, Artificial Sequence
  gNA Variant Scaffold
uacuggcgcuuuuaucucauuacuuugagagccaucaccagcgacuaugucguauggguaaagcgcaggaguuucuauggaaacccugaagcaucaaag

SEQ ID NO: 2106 - RNA, 99 nt, Artificial Sequence
  gNA Variant Scaffold
guacuggcgccuuuaucucauuacuuugagagccaucaccagcgacuaugucguauggguaaagcgcuuacggacuucgguccguaagaagcaucaaag

SEQ ID NO: 2107 - RNA, 90 nt, Artificial Sequence
  gNA Variant Scaffold
uacuggcgcuuuuaucucauuacuuugagagccaucaccagcgacuaugucguauggguaaagcgcugcgcuugcgcagaagcaucaaag

SEQ ID NO: 2108 - RNA, 108 nt, Artificial Sequence
  gNA Variant Scaffold
uacuggcgcuuuuaucugauuacuuugagagccaucaccagcgacuaugucguauggguaaagcgcuuauuuaucggagagaaauccgauaaauaagaagcaucaaag

SEQ ID NO: 2109 - RNA, 108 nt, Artificial Sequence
  gNA Variant Scaffold
uacuggcgcuuuuaucgcauuacuuugagagccaucaccagcgacuaugucguauggguaaagcgcuuauuuaucggagagaaauccgauaaauaagaagcaucaaag

SEQ ID NO: 2110 - RNA, 110 nt, Artificial Sequence
  gNA Variant Scaffold
uacuggcgcuuuuaucucauuacuuugagagccaucaccagcgacuaugucguauggguaaagcgcuuauuuaucggagacuucgguccgauaaauaagaagcaucaaag

SEQ ID NO: 2111 - RNA, 97 nt, Artificial Sequence
  gNA Variant Scaffold
uacuggcgcuuuuaucucauuacuuugagagccaucaccagcgacuaugucguauggguaaagcgcacaugaggauuacccaugugaagcaucaaag

SEQ ID NO: 2112 - RNA, 106 nt, Artificial Sequence
  gNA Variant Scaffold
gcuggcgcuuuuaucucauuacuuugagagccaucaccagcgacuaugucguauggguaaagcgcuuauuuaucgugagaaauccgauaaauaagaagcaucaaag

SEQ ID NO: 2113 - RNA, 96 nt, Artificial Sequence
  gNA Variant Scaffold
uacuggcgcuuuuaucucauuacuuugagagccaucaccagcgacuaugucguauggguaaagcgcugcaugucuaagacagcagaagcaucaaag

SEQ ID NO: 2114 - RNA, 90 nt, Artificial Sequence
  gNA Variant Scaffold
uacuggcgcuuuuaucucauuacuuugagagccaucaccagcgacuaugucguauggguaaagcgcagggcuucggccgaagcaucaaag

SEQ ID NO: 2115 - RNA, 98 nt, Artificial Sequence
  gNA Variant Scaffold
uacuggcgcuuuuaucucauuacuuugagagccaucaccagcgacuaugucguauggguaaagcgcaauccauugcacuccggauugaagcaucaaag

SEQ ID NO: 2116 - RNA, 108 nt, Artificial Sequence
  gNA Variant Scaffold
uacuggcgcuuuucucgcauuacuuugagagccaucaccagcgacuaugucguauggguaaagcgcuuauuuaucggagagaaauccgauaaauaagaagcaucaaag

SEQ ID NO: 2117 - RNA, 108 nt, Artificial Sequence
  gNA Variant Scaffold
uacuggcgcuuuuaucucauuacuuugagagccaucaccagcgacuaugucguauggguaaagcgcuuauuuaucggacuucgguccgauaaauaagaagcaucaaag

SEQ ID NO: 2118 - RNA, 100 nt, Artificial Sequence
  gNA Variant Scaffold
uacuggcgcuuuuaucucauuacuuugagagccaucaccagcgacuaugucguauggguaaagcgcugcucguuugcggcuacgagcagaagcaucaaag

SEQ ID NO: 2119 - RNA, 100 nt, Artificial Sequence
  gNA Variant Scaffold
uacuggcgcuuuuaucucauuacuuugagagccaucaccagcgacuaugucguauggguaaagcgcuuauuuaucgagagauaaauaagaagcaucaaag

SEQ ID NO: 2120 - RNA, 107 nt, Artificial Sequence
  gNA Variant Scaffold
uacggcgcuuuuaucucauuacuuugagagccaucaccagcgacuaugucguauggguaaagcgcuuauuuaucggagagaaauccgauaaauaagaagcaucaaag

SEQ ID NO: 2121 - RNA, 99 nt, Artificial Sequence
  gNA Variant Scaffold
uacuggcgccuuuuaucucauuacuuugagagccaucaccagcgacuaugucguauggguaaagcgcuuacggacuucgguccguaagaagcaucaaag

SEQ ID NO: 2122 - RNA, 108 nt, Artificial Sequence
  gNA Variant Scaffold
uacuggcgcuuuuaucucauuacuuugagagccaucaccagcgacuaugucguaucgguaaagcgcuuauuuaucggagagaaauccgauaaauaagaagcaucaaag

SEQ ID NO: 2123 - RNA, 108 nt, Artificial Sequence
  gNA Variant Scaffold
uacuggcgccuuuaucucauuacuuugagagccaucaccagcgacuaugucguauggguaaagcgcuuauuuaucggacuucgguccgauaaauaagaagcaucaaag

SEQ ID NO: 2124 - RNA, 105 nt, Artificial Sequence
  gNA Variant Scaffold
uacuggcgcuuuuaucucauuacuuugagagccaucaccagcgacuaugucguauggguaaagcgcuuauuuaucgagaaauccgauaaauaagaagcaucaaag

SEQ ID NO: 2125 - RNA, 103 nt, Artificial Sequence
  gNA Variant Scaffold
gcgcuuuuaucucauuacuuugagagccaucaccagcgacuaugucguauggguaaagcgcuuauuuaucggagagaaauccgauaaauaagaagcaucaaag

SEQ ID NO: 2126 - RNA, 103 nt, Artificial Sequence
  gNA Variant Scaffold
uacuggcgcuuuuaucucauuacuuugagagccaucaccagcgacuaugucguauggguaaagcgcuuauuuaucggagagagauaaauaagaagcaucaaag

SEQ ID NO: 2127 - RNA, 108 nt, Artificial Sequence
  gNA Variant Scaffold
uacuggcgcuuuuaucucauuacuuuggagagccaucaccagcgacuaugucguauggguaaagcgcuuauuuaucggagaguauccgauaaauaagaagcaucaaag

SEQ ID NO: 2128 - RNA, 109 nt, Artificial Sequence
  gNA Variant Scaffold
uacuggcgcuuuuaucucauuacuuugagagccaucaccagcgacuauguucguauggguaaagcgcuuauuuaucggagagaaauccgauaaauaagaagcaucaaag

SEQ ID NO: 2129 - RNA, 105 nt, Artificial Sequence
  gNA Variant Scaffold
agcgcuuuuaucucauuacuuugagagccaucaccagcgacuaugucguauggguaaagcgcuuauuuaucggagagaaaugccgauaaauaagaagcaucaaag

SEQ ID NO: 2130 - RNA, 109 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaauaagaagcaucaaag

SEQ ID NO: 2131 - RNA, 109 nt, Artificial Sequence
  gNA Variant Scaffold
uacuggcgcuuuuaucucauuacuuugagagccaucaccagcgacuaugucguauggguaaagcgcuuauuguaucggagagaaauccgauaaauaagaagcaucaaag

SEQ ID NO: 2132 - RNA, 102 nt, Artificial Sequence
  gNA Variant Scaffold
gcgcuuuuaucucauuacuuugagagccaucaccagcgacuaugucguauggguaaagcgcuuauuuaucggacuucgguccgauaaauaagcgcaucaaag

SEQ ID NO: 2133 - RNA, 108 nt, Artificial Sequence
  gNA Variant Scaffold
uacuggcgcuuuucucucauuacuuugagagccaucaccagcgacuaugucguauggguaaagcgcuuauuuaucggagagaaauccgauaaauaagaagcaucaaag

SEQ ID NO: 2134 - RNA, 106 nt, Artificial Sequence
  gNA Variant Scaffold
guggcgcuuuuaucucauuacuuugagagccaucaccagcgacuaugucguauggguaaagcgcuuauuuaucggagagaaauccgauaaauaagaagcaucaaag

SEQ ID NO: 2135 - RNA, 110 nt, Artificial Sequence
  gNA Variant Scaffold
uacuggcgcuuuuaucucauuacuuugagagccaucaccagcgaccuuaugucguauggguaaagcgcuuauuuaucggagagaaauccgauaaauaagaagcaucaaag

SEQ ID NO: 2136 - RNA, 107 nt, Artificial Sequence
  gNA Variant Scaffold
gauggcgcuuuuaucucauuacuuugagagccaucaccagcgacuaugucguauggguaaagcgcuuauuuaucggacuucgguccgauaaauaagaagcaucaaag

SEQ ID NO: 2137 - RNA, 106 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaagaagcaucaaag

SEQ ID NO: 2138 - RNA, 109 nt, Artificial Sequence
  gNA Variant Scaffold
uacuggcgcuuuuaucucauuacuuugagagccaucaccagcgaucuaugucguauggguaaagcgcuuauuuaucggagagaaauccgauaaauaagaagcaucaaag

SEQ ID NO: 2139 - RNA, 106 nt, Artificial Sequence
  gNA Variant Scaffold
uacuggcgcuuuuaucucauuacuuugagagccaucaccagcgacuaugucguauggguaaaggcuuauuuaucggagagaaauccgauaaaaagaagcaucaaag

SEQ ID NO: 2140 - RNA, 107 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaaagaagcaucaaag

SEQ ID NO: 2141 - RNA, 107 nt, Artificial Sequence
  gNA Variant Scaffold
uacuggcgcuuuaucucauuacuuugagagccaucaccagcgacuaugucguauggguaaagcgcuuauuuaucggacuucgguccgauaaauaagaagcaucaaag

SEQ ID NO: 2142 - RNA, 98 nt, Artificial Sequence
  gNA Variant Scaffold
cggcgcuuuucucgcauuacuuugagagccaucaccagcgacuaugucguauggguaaagcgcuuauuguaucgagagauaaauaagaagcaucaaag

SEQ ID NO: 2143 - RNA, 107 nt, Artificial Sequence
  gNA Variant Scaffold
cacuggcgcuuuuaucucauuacuuugagagccaucaccagcgacuaugucguauggguaaagcgcuuauuuucggagagaaauccgauaaauaagaagcaucaaag

SEQ ID NO: 2144 - RNA, 106 nt, Artificial Sequence
  gNA Variant Scaffold
uacuggcgcuuuaucucauuacuuugagagccaucaccagcgacuucggucguauggguaaagcgcuuauguaucggcuucggccgauacauaagaagcaucaaag

SEQ ID NO: 2145 - RNA, 107 nt, Artificial Sequence
  gNA Variant Scaffold
uacuggcgcuuuuaucucauuacuuugagagccaucaccagcgacuucggucguauggguaaagcgcuuauguaucggcuucggccgauacauaagaagcaucaaag

SEQ ID NO: 2146 - RNA, 109 nt, Artificial Sequence
  gNA Variant Scaffold
uacuggcgcuuuuaucucauuacuuugagagccaucaccagcgacuaugucguaugggugaaagcgcuuauuuaucggagagaaauccgauaaauaagaagcaucaaag

SEQ ID NO: 2147 - RNA, 64 nt, Artificial Sequence
  gNA Variant Scaffold
uacuggcgcuuuuaucucauuacuuugagagccaucaccagcgacuucggucguauggguaaag

SEQ ID NO: 2148 - RNA, 62 nt, Artificial Sequence
  gNA Variant Scaffold
gaugggcuuuuaucucauuacuuugagagccaucaccagcgacuucggucguauggguaaag

SEQ ID NO: 2149 - RNA, 105 nt, Artificial Sequence
  gNA Variant Scaffold
gaugggcuuuuaucucauuacuuugagagccaucaccagcgacuucggucguauggguaaagcgcuuauuuaucggcuucggccgauaaauaagaagcaucaaag

SEQ ID NO: 2150 - RNA, 156 nt, Artificial Sequence
  gNA Variant Scaffold
uacuggcgcuuuuaucucauuacuuugagagccaucaccagcgacuaugucguauggguaaagcgcuacacugggaucgcugaauuagagaucggcguccuuucauucuauauacuuuggaguuuuaaaaugucucuaaguacagaagcaucaaag

SEQ ID NO: 2151 - RNA, 103 nt, Artificial Sequence
  gNA Variant Scaffold
ggcgcuuuuaucucauuacuuugagagccaucaccagcgacuucggucguauggguaaagcgcuuauuuaucggcuucggccgauaaauaagaagcaucaaag

SEQ ID NO: 2152 - RNA, 106 nt, Artificial Sequence
  gNA Variant Scaffold
gcuggcgcuuuuaucucauuacuuugagagccaucaccagcgacuucggucguauggguaaagcgcuuauuuaucggcuucggccgauaaauaagaagcaucaaag

SEQ ID NO: 2153 - RNA, 109 nt, Artificial Sequence
  gNA Variant Scaffold
uacuggcgcuuuuaucucauuacuuugagagccaucaccagcgacuucggucguauggguaaagcgcuuauuuaucggagagaaauccgauaaauaagaagcaucaaag

SEQ ID NO: 2154 - RNA, 112 nt, Artificial Sequence
  gNA Variant Scaffold
uacuggcgcuuuuaucucauuacuuugagagccaugcuccaccagcgacuaugucguauggguaaagcgcuuauuuaucggagagaaauccgauaaauaagaagcaucaaag

SEQ ID NO: 2155 - RNA, 97 nt, Artificial Sequence
  gNA Variant Scaffold
uacuggcgcuuuuaucucauuacuuugagagccaucaccagcgacuaugucguauggguaaagcgggguuaggguuaggguuagggaagcaucaaag

SEQ ID NO: 2156 - RNA, 96 nt, Artificial Sequence
  gNA Variant Scaffold
uacuggcgcuuuuaucucauuacuuugagagccaucaccagcgacuaugucguauggguaaagcggagggagggagggagagggaaagcaucaaag

SEQ ID NO: 2157 - RNA, 101 nt, Artificial Sequence
  gNA Variant Scaffold
uacuggcgcuuuuaucucauuacuuugagagccaucaccagcgacuaugucguauggguaaagcguuggguuaggguuaggguuagggaaaagcaucaaag

SEQ ID NO: 2158 - RNA, 91 nt, Artificial Sequence
  gNA Variant Scaffold
uacuggcgcuuuuaucucauuacuuugagagccaucaccagcgacuaugucguauggguaaagcgcagggcuucggccggaagcaucaaag

SEQ ID NO: 2159 - RNA, 103 nt, Artificial Sequence
  gNA Variant Scaffold
uacuggcgcuuuuaucucauuacuuugagagccaucaccagcgacuaugucguauggguaaagcgccugcucaguacgagaggaaccgcaggaagcaucaaag

SEQ ID NO: 2160 - RNA, 90 nt, Artificial Sequence
  gNA Variant Scaffold
uacuggcgcuuuuaucugauuacuuugagagccaucaccagcgacuaugucguauggguaaagcgcccucuucggagggaagcaucaaag

SEQ ID NO: 2161 - RNA, 98 nt, Artificial Sequence
  gNA Variant Scaffold
uacuggcgccuuuaucugauuacuuugagagccaucaccagcgacuaugucguauggguaaagcgcuuacggacuucgguccguaagaagcaucaaag

SEQ ID NO: 2162 - RNA, 98 nt, Artificial Sequence
  gNA Variant Scaffold
uacuggcgcuuuuaucugauuacuuugagagccaucaccagcgacuaugucguauggguaaagcgcggacgaccucucggucguccgaagcaucaaag

SEQ ID NO: 2163 - RNA, 108 nt, Artificial Sequence
  gNA Variant Scaffold
uacuggcgcuuuuaucugauuacuuugagagccaucaccagcgacuaugucguauggguaaagcgcaggugggacgaccucucggucguccuaucugaagcaucaaag

SEQ ID NO: 2164 - RNA, 99 nt, Artificial Sequence
  gNA Variant Scaffold
uacuggcgccuuuaucugcauuacuuugagagccaucaccagcgacuaugucguauggguaaagcgcuuacggacuucgguccguaagaagcaucaaag

SEQ ID NO: 2165 - RNA, 97 nt, Artificial Sequence
  gNA Variant Scaffold
gcuggcgcuuuuaucugauuacuuugagagccaucaccagcgacuaugucguauggguaaagcgcuuacggacuucgguccguaagaagcaucaaag

SEQ ID NO: 2166 - RNA, 108 nt, Artificial Sequence
  gNA Variant Scaffold
uacuggcgccuuuaucugauuacuuugagagccaucaccagcgacuaugucguauggguaaagcgcaggugggacgaccucucggucguccuaucugaagcaucaaag

SEQ ID NO: 2167 - RNA, 98 nt, Artificial Sequence
  gNA Variant Scaffold
uacuggcgccuuuaucugauuacuuugagagccaucaccagcgacuaugucguauggguaaagcgcggacgaccucucggucguccgaagcaucaaag

SEQ ID NO: 2168 - RNA, 90 nt, Artificial Sequence
  gNA Variant Scaffold
uacuggcgccuuuaucucauuacuuugagagccaucaccagcgacuaugucguauggguaaagcgcccucuucggagggaagcaucaaag

SEQ ID NO: 2169 - RNA, 98 nt, Artificial Sequence
  gNA Variant Scaffold
uacuggcgcuuuuaucucauuacuuugagagccaucaccagcgacuaugucguauggguaaagcgcuuacggacuucgguccguaagaagcaucaaag

SEQ ID NO: 2170 - RNA, 99 nt, Artificial Sequence
  gNA Variant Scaffold
uacuggcgccuuuaucaucauuacuuugagagccaucaccagcgacuaugucguauggguaaagcgcuuacggacuucgguccguaagaagcaucaaag

SEQ ID NO: 2171 - RNA, 194 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagggccggcauggucccagccuccucgcuggcgccggcugggcaacauuccgaggggaccguccccucgguaauggcgaaugggaccc

SEQ ID NO: 2172 - RNA, 108 nt, Artificial Sequence
  gNA Variant Scaffold
uacuggcgccuuuaucucauuacuuugagagccaucaccagcgacuaugucguauggguaaagcgcaggugggacgaccucucggucguccuaucugaagcaucaaag

SEQ ID NO: 2173 - RNA, 106 nt, Artificial Sequence
  gNA Variant Scaffold
uacuggcgcuuuuaucucauuacuuugagagccaucaccagcgacuaugucguauggguaaagcgcuuauuuaucggagaaauccgauaaauaagaagcaucaaag

SEQ ID NO: 2174 - RNA, 98 nt, Artificial Sequence
  gNA Variant Scaffold
uacuggcgccuuuaucucauuacuuugagagccaucaccagcgacuaugucguauggguaaagcgcggacgaccucucggucguccgaagcaucaaag

SEQ ID NO: 2175 - RNA, 92 nt, Artificial Sequence
  gNA Variant Scaffold
uacuggcgcuuuuaucucauuacuuugagagccaucaccagcgacuaugucguauggguaaagcgccggacuucgguccggaagcaucaaag

SEQ ID NO: 2176 - RNA, 108 nt, Artificial Sequence
  gNA Variant Scaffold
uacuggcgcuuuuaucggauuacuuugagagccaucaccagcgacuaugucguauggguaaagcgcuuauuuaucggagagaaauccgauaaauaagaagcaucaaag

SEQ ID NO: 2177 - RNA, 98 nt, Artificial Sequence
  gNA Variant Scaffold
uacuggcgcuuuuaucucauuacuuugagagccaucaccagcgacuaugucguauggguaaagcgcggacgaccucucggucguccgaagcaucaaag

SEQ ID NO: 2178 - RNA, 89 nt, Artificial Sequence
  gNA Variant Scaffold
gcuggcgcuuuuaucugauuacuuugagagccaucaccagcgacuaugucguauggguaaagcgcccucuucggagggaagcaucaaag

SEQ ID NO: 2179 - RNA, 88 nt, Artificial Sequence
  gNA Variant Scaffold
gcuggcgccuuuaucugauuacuuugagagccaucaccagcgacuaugucguauggguaaagcucccucuucggagggagcaucaaag

SEQ ID NO: 2180 - RNA, 197 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggggucggcauggcaucuccaccuccucgcgguccgaccugggcauccgaaggaggacgcacguccacucggauggcuaagggagagcca

SEQ ID NO: 2181 - RNA, 88 nt, Artificial Sequence
  gNA Variant Scaffold
gcuggcgccuuuaucugauuacuuugagagccaucaccagcgacuaugucguauggguaaagcgcccucuucggagggcgcaucaaag

SEQ ID NO: 2182 - RNA, 186 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaguuuuggccggcauggucccagccuccucgcuggcgccggcugggcaacaugcuucggcauggcgaaugggaccccggg

SEQ ID NO: 2183 - RNA, 97 nt, Artificial Sequence
  gNA Variant Scaffold
gauggcgccuuuaucucauuacuuugagagccaucaccagcgacuaugucguauggguaaagcgcuuacggacuucgguccguaagaagcaucaaag

SEQ ID NO: 2184 - RNA, 89 nt, Artificial Sequence
  gNA Variant Scaffold
gcuggcgcuuuuaucucauuacuuugagagccaucaccagcgacuaugucguauggguaaagcgcccucuucggagggaagcaucaaag

SEQ ID NO: 2185 - RNA, 96 nt, Artificial Sequence
  gNA Variant Scaffold
gcuggcgccuuuaucugauuacuuugagagccaucaccagcgacuaugucguauggguaaagcucuuacggacuucgguccguaagagcaucaaag

SEQ ID NO: 2186 - RNA, 96 nt, Artificial Sequence
  gNA Variant Scaffold
gcuggcgccuuuaucugauuacuuugagagccaucaccagcgacuaugucguauggguaaagcucggacgaccucucggucguccgagcaucaaag

SEQ ID NO: 2187 - RNA, 160 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagccugucaccggaugugcuuuccggucugaugaguccgugaggacgaaacagg

SEQ ID NO: 2188 - RNA, 97 nt, Artificial Sequence
  gNA Variant Scaffold
gcuggcgcuuuuaucugauuacuuugagagccaucaccagcgacuaugucguauggguaaagcgcggacgaccucucggucguccgaagcaucaaag

SEQ ID NO: 2189 - RNA, 97 nt, Artificial Sequence
  gNA Variant Scaffold
gcuggcgccuuuaucugauuacuuugagagccaucaccagcgacuaugucguauggguaaagcgcggacgaccucucggucguccgaagcaucaaag

SEQ ID NO: 2190 - RNA, 106 nt, Artificial Sequence
  gNA Variant Scaffold
gcuggcgccuuuaucugauuacuuugagagccaucaccagcgacuaugucguauggguaaagcucaggugggacgaccucucggucguccuaucugagcaucaaag

SEQ ID NO: 2191 - RNA, 177 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggauggccggcauggucccagccuccucgcuggcgccggcugggcaacaccuucggguggcgaaugggac

SEQ ID NO: 2192 - RNA, 107 nt, Artificial Sequence
  gNA Variant Scaffold
gcuggcgcuuuuaucugauuacuuugagagccaucaccagcgacuaugucguauggguaaagcgcaggugggacgaccucucggucguccuaucugaagcaucaaag

SEQ ID NO: 2193 - RNA, 109 nt, Artificial Sequence
  gNA Variant Scaffold
uacuggcgcuuuuaucucauuacuuugagagccaucaccagcgacuaugucguacuggguaaagcgcuuauuuaucggagagaaauccgauaaauaagaagcaucaaag

SEQ ID NO: 2194 - RNA, 107 nt, Artificial Sequence
  gNA Variant Scaffold
uacuggcgcuuuuaucucauuacuuugagagccaucaccagcgacuaugucguauggguaaagcgcuuauuuaucgugagaaauccgauaaauaagaagcaucaaag

SEQ ID NO: 2195 - RNA, 109 nt, Artificial Sequence
  gNA Variant Scaffold
guacuggcgcuuuuaucucauuacuuugagagccaucaccagcgacuaugucguauggguaaagcgcuuauuuaucggagagaaauccgauaaauaagaagcaucaaag

SEQ ID NO: 2196 - RNA, 97 nt, Artificial Sequence
  gNA Variant Scaffold
gcuggcgcuuuuaucucauuacuuugagagccaucaccagcgacuaugucguauggguaaagcgcggacgaccucucggucguccgaagcaucaaag

SEQ ID NO: 2197 - RNA, 97 nt, Artificial Sequence
  gNA Variant Scaffold
gcuggcgccuuuaucugauuacuuugagagccaucaccagcgacuaugucguauggguaaagcgcuuacggacuucgguccguaagaagcaucaaag

SEQ ID NO: 2198 - RNA, 107 nt, Artificial Sequence
  gNA Variant Scaffold
gcuggcgcuuuuaucucauuacuuugagagccaucaccagcgacuaugucguauggguaaagcgcuuauuuaucggagagaaauccgauaaauaagaagcaucaaag

SEQ ID NO: 2199 - RNA, 97 nt, Artificial Sequence
  gNA Variant Scaffold
gcuggcgccuuuaucucauuacuuugagagccaucaccagcgacuaugucguauggguaaagcgcuuacggacuucgguccguaagaagcaucaaag

SEQ ID NO: 2200 - RNA, 89 nt, Artificial Sequence
  gNA Variant Scaffold
gcuggcgccuuuaucugauuacuuugagagccaucaccagcgacuaugucguauggguaaagcgcccucuucggagggaagcaucaaag

SEQ ID NO: 2201 - RNA, 107 nt, Artificial Sequence
  gNA Variant Scaffold
gcuggcgcuuuuaucucauuacuuugagagccaucaccagcgacuaugucguauggguaaagcgcaggugggacgaccucucggucguccuaucugaagcaucaaag

SEQ ID NO: 2202 - RNA, 107 nt, Artificial Sequence
  gNA Variant Scaffold
gcuggcgccuuuaucucauuacuuugagagccaucaccagcgacuaugucguauggguaaagcgcaggugggacgaccucucggucguccuaucugaagcaucaaag

SEQ ID NO: 2203 - RNA, 107 nt, Artificial Sequence
  gNA Variant Scaffold
gcuggcgccuuuaucugauuacuuugagagccaucaccagcgacuaugucguauggguaaagcgcaggugggacgaccucucggucguccuaucugaagcaucaaag

SEQ ID NO: 2204 - RNA, 98 nt, Artificial Sequence
  gNA Variant Scaffold
uacuggcgcuuuuaucugauuacuuugagagccaucaccagcgacuaugucguauggguaaagcgcuuacggacuucgguccguaagaagcaucaaag

SEQ ID NO: 2205 - RNA, 89 nt, Artificial Sequence
  gNA Variant Scaffold
gcuggcgccuuuaucucauuacuuugagagccaucaccagcgacuaugucguauggguaaagcgcccucuucggagggaagcaucaaag

SEQ ID NO: 2206 - RNA, 97 nt, Artificial Sequence
  gNA Variant Scaffold
gcuggcgcuuuuaucucauuacuuugagagccaucaccagcgacuaugucguauggguaaagcgcuuacggacuucgguccguaagaagcaucaaag

SEQ ID NO: 2207 - RNA, 97 nt, Artificial Sequence
  gNA Variant Scaffold
gcuggcgccuuuaucucauuacuuugagagccaucaccagcgacuaugucguauggguaaagcgcggacgaccucucggucguccgaagcaucaaag

SEQ ID NO: 2208 - RNA, 177 nt, Artificial Sequence
  gNA Variant Scaffold
gauggccggcauggucccagccuccucgcuggcgccggcugggcaacaccuucggguggcgaaugggacuacuggcgcuuuuaucucauuacuuugagagccaucaccagcgacuaugucguauggguaaagcgcuuauuuaucggagagaaauccgauaaauaagaagcaucaaag

SEQ ID NO: 2209 - RNA, 194 nt, Artificial Sequence
  gNA Variant Scaffold
ggccggcauggucccagccuccucgcuggcgccggcugggcaacauuccgaggggaccguccccucgguaauggcgaaugggacccuacuggcgcuuuuaucucauuacuuugagagccaucaccagcgacuaugucguauggguaaagcgcuuauuuaucggagagaaauccgauaaauaagaagcaucaaag

SEQ ID NO: 2210 - RNA, 96 nt, Artificial Sequence
  gNA Variant Scaffold
gcuggcgccuuuaucugauuacuuugagagccaucaccagcgacuaugucguauggguaaagcgcuuacggacuucgguccguaagcgcaucaaag

SEQ ID NO: 2211 - RNA, 172 nt, Artificial Sequence
  gNA Variant Scaffold
cgugguuagggccacguuaaauaguugcuuaagcccuaagcguugaucuucggaucaggugcaauacuggcgcuuuuaucucauuacuuugagagccaucaccagcgacuaugucguauggguaaagcgcuuauuuaucggagagaaauccgauaaauaagaagcaucaaag

SEQ ID NO: 2212 - RNA, 197 nt, Artificial Sequence
  gNA Variant Scaffold
gggucggcauggcaucuccaccuccucgcgguccgaccugggcauccgaaggaggacgcacguccacucggauggcuaagggagagccauacuggcgcuuuuaucucauuacuuugagagccaucaccagcgacuaugucguauggguaaagcgcuuauuuaucggagagaaauccgauaaauaagaagcaucaaag

SEQ ID NO: 2213 - RNA, 171 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagccaguacugaugaguccgugaggacgaaacgaguaagcucgucuacuggcgcuuuuaucucau

SEQ ID NO: 2214 - RNA, 99 nt, Artificial Sequence
  gNA Variant Scaffold
uacuggcgccuuuaucucauuacuuuagagagccaucaccagcgacuaugucguauggguaaagcgcuuacggacuucgguccguaagaagcaucaaag

SEQ ID NO: 2215 - RNA, 157 nt, Artificial Sequence
  gNA Variant Scaffold
cgacuacugaugaguccgugaggacgaaacgaguaagcucgucuagucguacuggcgcuuuuaucucauuacuuugagagccaucaccagcgacuaugucguauggguaaagcgcuuauuuaucggagagaaauccgauaaauaagaagcaucaaag

SEQ ID NO: 2216 - RNA, 106 nt, Artificial Sequence
  gNA Variant Scaffold
gcuggcgccuuuaucugauuacuuugagagccaucaccagcgacuaugucguauggguaaagcgcaggugggacgaccucucggucguccuaucugcgcaucaaag

SEQ ID NO: 2217 - RNA, 97 nt, Artificial Sequence
  gNA Variant Scaffold
uacuggcgccuuuaucucauuacuuuagagccaucaccagcgacuaugucguauggguaaagcgcuuacggacuucgguccguaagaagcaucaaag

SEQ ID NO: 2218 - RNA, 186 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcauuccucagaaaaugacaaaccuguggggcguaaguagaucuucggaucuaugaucgugcagacguuaaaaucaggu

SEQ ID NO: 2219 - RNA, 171 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucgcguguagcgaagca

SEQ ID NO: 2220 - RNA, 186 nt, Artificial Sequence
  gNA Variant Scaffold
cauuccucagaaaaugacaaaccuguggggcguaaguagaucuucggaucuaugaucgugcagacguuaaaaucagguuacuggcgcuuuuaucucauuacuuugagagccaucaccagcgacuaugucguauggguaaagcgcuuauuuaucggagagaaauccgauaaauaagaagcaucaaag

SEQ ID NO: 2221 - RNA, 186 nt, Artificial Sequence
  gNA Variant Scaffold
uuuuggccggcauggucccagccuccucgcuggcgccggcugggcaacaugcuucggcauggcgaaugggaccccggguacuggcgcuuuuaucucauuacuuugagagccaucaccagcgacuaugucguauggguaaagcgcuuauuuaucggagagaaauccgauaaauaagaagcaucaaag

SEQ ID NO: 2222 - RNA, 171 nt, Artificial Sequence
  gNA Variant Scaffold
cgacuacugaugaguccgugaggacgaaacgaguaagcucgucuagucgcguguagcgaagcauacuggcgcuuuuaucucauuacuuugagagccaucaccagcgacuaugucguauggguaaagcgcuuauuuaucggagagaaauccgauaaauaagaagcaucaaag

SEQ ID NO: 2223 - RNA, 168 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggggagccccgcugaugaggucggggagaccgaaagggacuucggucccuacggggcuccc

SEQ ID NO: 2224 - RNA, 144 nt, Artificial Sequence
  gNA Variant Scaffold
ccacccccaccaccacccccacccccaccaccacccuacuggcgcuuuuaucucauuacuuugagagccaucaccagcgacuaugucguauggguaaagcgcuuauuuaucggagagaaauccgauaaauaagaagcaucaaag

SEQ ID NO: 2225 - RNA, 157 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucg

SEQ ID NO: 2226 - RNA, 172 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgugguuagggccacguuaaauaguugcuuaagcccuaagcguugaucuucggaucaggugcaa

SEQ ID NO: 2227 - RNA, 184 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagggcaauaaagcgguuacaagcccgcaaaaauagcagaguaaugucgcgauagcgcggcauuaaugcagcuuuauug

SEQ ID NO: 2228 - RNA, 122 nt, Artificial Sequence
  gNA Variant Scaffold
uacuggcgcuuuuaucucauuacuauuaucucauuacuuugagagccaucaccagcgacuaugucguauggguaaagcgcuuauuuaucggagagaaauccgauaaauaagaagcaucaaag

SEQ ID NO: 2229 - RNA, 184 nt, Artificial Sequence
  gNA Variant Scaffold
ggcaauaaagcgguuacaagcccgcaaaaauagcagaguaaugucgcgauagcgcggcauuaaugcagcuuuauuguacuggcgcuuuuaucucauuacuuugagagccaucaccagcgacuaugucguauggguaaagcgcuuauuuaucggagagaaauccgauaaauaagaagcaucaaag

SEQ ID NO: 2230 - RNA, 185 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagacccgcaaggccgacggcauccgccgccgcuggugcaaguccagccgccccuucgggggcgggcgcucauggguaac

SEQ ID NO: 2231 - RNA, 63 nt, Artificial Sequence
  gNA Variant Scaffold
uacuggcgcuuuuaucucauuacuuugagagccaucaccagcgacuaugucguauggguaaag

SEQ ID NO: 2232 - RNA, 168 nt, Artificial Sequence
  gNA Variant Scaffold
gggagccccgcugaugaggucggggagaccgaaagggacuucggucccuacggggcucccuacuggcgcuuuuaucucauuacuuugagagccaucaccagcgacuaugucguauggguaaagcgcuuauuuaucggagagaaauccgauaaauaagaagcaucaaag

SEQ ID NO: 2233 - RNA, 171 nt, Artificial Sequence
  gNA Variant Scaffold
ccaguacugaugaguccgugaggacgaaacgaguaagcucgucuacuggcgcuuuuaucucauuacuggcgcuuuuaucucauuacuuugagagccaucaccagcgacuaugucguauggguaaagcgcuuauuuaucggagagaaauccgauaaauaagaagcaucaaag

SEQ ID NO: 2234 - RNA, 185 nt, Artificial Sequence
  gNA Variant Scaffold
acccgcaaggccgacggcauccgccgccgcuggugcaaguccagccgccccuucgggggcgggcgcucauggguaacuacuggcgcuuuuaucucauuacuuugagagccaucaccagcgacuaugucguauggguaaagcgcuuauuuaucggagagaaauccgauaaauaagaagcaucaaag

SEQ ID NO: 2235 - RNA, 160 nt, Artificial Sequence
  gNA Variant Scaffold
ccugucaccggaugugcuuuccggucugaugaguccgugaggacgaaacagguacuggcgcuuuuaucucauuacuuugagagccaucaccagcgacuaugucguauggguaaagcgcuuauuuaucggagagaaauccgauaaauaagaagcaucaaag

SEQ ID NO: 2236 - RNA, 100 nt, Artificial Sequence
  gNA Variant Scaffold
guacuggcgccuuuaucucauuacuuugagagccaucaccagcgacuaugucguaguggguaaagcgcuuacggacuucgguccguaagaagcaucaaag

SEQ ID NO: 2237 - RNA, 91 nt, Artificial Sequence
  gNA Variant Scaffold
guacuggcgcuuuuaucugauuacuuugagagccaucaccagcgacuaugucguaguggguaaagcucccucuucggagggagcaucaaag

SEQ ID NO: 2238 - RNA, 89 nt, Artificial Sequence
  gNA Variant Scaffold
acuggcgcuuuuaucugauuacuuugagagccaucaccagcgacuaugucguaguggguaaagcucccucuucggagggagcaucaaag

SEQ ID NO: 2239 - RNA, 97 nt, Artificial Sequence
  gNA Variant Scaffold
acuggcgccuuuaucucauuacuuugagagccaucaccagcgacuaugucguauggguaaagcgcuuacggacuucgguccguaagaagcaucaaag

SEQ ID NO: 2240 - RNA, 89 nt, Artificial Sequence
  gNA Variant Scaffold
gcuggcgcuuuuaucugauuacuuugagagccaucaccagcgacuaugucguaguggguaaagcucccucuucggagggagcaucaaag

SEQ ID NO: 2241 - RNA, 88 nt, Artificial Sequence
  gNA Variant Scaffold
acuggcgcuuuuaucugauuacuuugagagccaucaccagcgacuaugucguauggguaaagcucccucuucggagggagcaucaaag

SEQ ID NO: 2242 - RNA, 97 nt, Artificial Sequence
  gNA Variant Scaffold
acuggcgccuuuaucugauuacuuugagagccaucaccagcgacuaugucguauggguaaagcgcuuacggacuucgguccguaagaagcaucaaag

SEQ ID NO: 2243 - RNA, 97 nt, Artificial Sequence
  gNA Variant Scaffold
acuggcgcuuuuaucugauuacuuugagagccaucaccagcgacuaugucguauggguaaagcgcuuacggacuucgguccguaagaagcaucaaag

SEQ ID NO: 2244 - RNA, 98 nt, Artificial Sequence
  gNA Variant Scaffold
acuggcgcuuuuaucugauuacuuugagagccaucaccagcgacuaugucguaguggguaaagcgcuuacggacuucgguccguaagaagcaucaaag

SEQ ID NO: 2245 - RNA, 89 nt, Artificial Sequence
  gNA Variant Scaffold
acuggcgcuuuuaucugauuacuuugagagccaucaccagcgacuaugucguauuggguaaagcucccucuucggagggagcaucaaag

SEQ ID NO: 2246 - RNA, 98 nt, Artificial Sequence
  gNA Variant Scaffold
acuggcgcuuuuaucugauuacuuugagagccaucaccagcgacuaugucguauuggguaaagcgcuuacggacuucgguccguaagaagcaucaaag

SEQ ID NO: 2247 - RNA, 98 nt, Artificial Sequence
  gNA Variant Scaffold
acuggcgccuuuaucaucauuacuuugagagccaucaccagcgacuaugucguauggguaaagcgcuuacggacuucgguccguaagaagcaucaaag

SEQ ID NO: 2248 - RNA, 90 nt, Artificial Sequence
  gNA Variant Scaffold
acuggcgcuuuuaucugauuacuuugagagccaucaccagcgacuaugucguaguggguaaagcgcccucuucggagggaagcaucaaag

SEQ ID NO: 2249 - RNA, 96 nt, Artificial Sequence
  gNA Variant Scaffold
acuggcgcuuuuaucugauuacuuugagagccaucaccagcgacuaugucguaguggguaaagcucacaugaggaucacccaugugagcaucaaag

SEQ ID NO: 2250 - RNA, 89 nt, Artificial Sequence
  gNA Variant Scaffold
acuggcacuuuuaccugauuacuuugagagccaacaccagcgacuaugucguaguggguaaagcucccucuucggagggagcaucaaag

SEQ ID NO: 2251 - RNA, 89 nt, Artificial Sequence
  gNA Variant Scaffold
acuggcacuuuuaucugauuacuuugagagccaucaccagcgacuaugucguaguggguaaagcucccucuucggagggagcaucaaag

SEQ ID NO: 2252 - RNA, 89 nt, Artificial Sequence
  gNA Variant Scaffold
acuggcccuuuuaucugauuacuuugagagccaucaccagcgacuaugucguaguggguaaagcucccucuucggagggagcaucaaag

SEQ ID NO: 2253 - RNA, 89 nt, Artificial Sequence
  gNA Variant Scaffold
acuggcgcuuuuaccugauuacuuugagagccaucaccagcgacuaugucguaguggguaaagcucccucuucggagggagcaucaaag

SEQ ID NO: 2254 - RNA, 89 nt, Artificial Sequence
  gNA Variant Scaffold
acuggcgcuuuuaucugauuacuuugagagccaacaccagcgacuaugucguaguggguaaagcucccucuucggagggagcaucaaag

SEQ ID NO: 2255 - RNA, 97 nt, Artificial Sequence
  gNA Variant Scaffold
acuggcaccuuuaccugauuacuuugagagccaacaccagcgacuaugucguauggguaaagcgcuuacggacuucgguccguaagaagcaucaaag

SEQ ID NO: 2256 - RNA, 97 nt, Artificial Sequence
  gNA Variant Scaffold
acuggcaccuuuaucugauuacuuugagagccaucaccagcgacuaugucguauggguaaagcgcuuacggacuucgguccguaagaagcaucaaag

SEQ ID NO: 2257 - RNA, 97 nt, Artificial Sequence
  gNA Variant Scaffold
acuggccccuuuaucugauuacuuugagagccaucaccagcgacuaugucguauggguaaagcgcuuacggacuucgguccguaagaagcaucaaag

SEQ ID NO: 2258 - RNA, 97 nt, Artificial Sequence
  gNA Variant Scaffold
acuggcgccuuuaucugauuacuuugagagccaacaccagcgacuaugucguauggguaaagcgcuuacggacuucgguccguaagaagcaucaaag

SEQ ID NO: 2259 - RNA, 89 nt, Artificial Sequence; identical to SEQ ID NO: 2240
  gNA Variant Scaffold

SEQ ID NO: 2260 - RNA, 90 nt, Artificial Sequence
  gNA Variant Scaffold
gacuggcgcuuuuaucugauuacuuugagagccaucaccagcgacuaugucguaguggguaaagcucccucuucggagggagcaucaaag

SEQ ID NO: 2261 - RNA, 90 nt, Artificial Sequence
  gNA Variant Scaffold
acuggcgccuuuaucugauuacuuuggagagccaucaccagcgacuaugucguaguggguaaagcucccucuucggagggagcaucaaag

SEQ ID NO: 2262 - RNA, 89 nt, Artificial Sequence
  gNA Variant Scaffold
acuggcgcauuuaucugauuacuuugugagccaucaccagcgacuaugucguaguggguaaagcucccucuucggagggagcaucaaag

SEQ ID NO: 2263 - RNA, 89 nt, Artificial Sequence
  gNA Variant Scaffold
acuggcgccuuuaucugauuacuuugagagccaucaccagcgacuaugucguaguggguaaagcucccucuucggagggagcaucaaag

SEQ ID NO: 2264 - RNA, 90 nt, Artificial Sequence
  gNA Variant Scaffold
acuggcgcuuuuaucugauuacuuuggagagccaucaccagcgacuaugucguaguggguaaagcucccucuucggagggagcaucaaag

SEQ ID NO: 2265 - RNA, 89 nt, Artificial Sequence
  gNA Variant Scaffold
acuggcgcauuuaucugauuacuuugagagccaucaccagcgacuaugucguaguggguaaagcucccucuucggagggagcaucaaag

SEQ ID NO: 2266 - RNA, 89 nt, Artificial Sequence
  gNA Variant Scaffold
acuggcgcuuuuaucugauuacuuugugagccaucaccagcgacuaugucguaguggguaaagcucccucuucggagggagcaucaaag

SEQ ID NO: 2267 - RNA, 90 nt, Artificial Sequence
  gNA Variant Scaffold
acuggcgcuuuuauucugauuacuuugagagccaucaccagcgacuaugucguaguggguaaagcucccucuucggagggagcaucaaag

SEQ ID NO: 2268 - RNA, 88 nt, Artificial Sequence
  gNA Variant Scaffold
acggcgcuuuuaucugauuacuuugagagccaucaccagcgacuaugucguaguggguaaagcucccucuucggagggagcaucaaag

SEQ ID NO: 2269 - RNA, 89 nt, Artificial Sequence
  gNA Variant Scaffold
acuggcgcuuuuauaugauuacuuugagagccaucaccagcgacuaugucguaguggguaaagcucccucuucggagggagcaucaaag

SEQ ID NO: 2270 - RNA, 90 nt, Artificial Sequence
  gNA Variant Scaffold
acuggcgcuuuuaucuugauuacuuugagagccaucaccagcgacuaugucguaguggguaaagcucccucuucggagggagcaucaaag

SEQ ID NO: 2271 - RNA, 89 nt, Artificial Sequence
  gNA Variant Scaffold
acuggcgcuuuuaucugauuacuuugagagccagcaccagcgacuaugucguaguggguaaagcucccucuucggagggagcaucaaag

SEQ ID NO: 2272 - RNA, 89 nt, Artificial Sequence
  gNA Variant Scaffold
acuggcgcuguuaucugauuacuucgagagccaucaccagcgacuaugucguaguggguaaagcucccucuucggagggagcaucgaag

SEQ ID NO: 2273 - RNA, 89 nt, Artificial Sequence
  gNA Variant Scaffold
acuggcgcucuuaucugauuacuucgagagccaucaccagcgacuaugucguaguggguaaagcucccucuucggagggagcaucgaag

SEQ ID NO: 2274 - RNA, 89 nt, Artificial Sequence
  gNA Variant Scaffold
acuggcgcuuguaucugauuacucugagagccaucaccagcgacuaugucguaguggguaaagcucccucuucggagggagcaucagag

SEQ ID NO: 2275 - RNA, 89 nt, Artificial Sequence
  gNA Variant Scaffold
acuggcgcuucuaucugauuacucugagagccaucaccagcgacuaugucguaguggguaaagcucccucuucggagggagcaucagag

SEQ ID NO: 2276 - RNA, 89 nt, Artificial Sequence
  gNA Variant Scaffold
acuggcgcuuugaucugauuaccuugagagccaucaccagcgacuaugucguaguggguaaagcucccucuucggagggagcaucaagg

SEQ ID NO: 2277 - RNA, 89 nt, Artificial Sequence
  gNA Variant Scaffold
acuggcgcuuucaucugauuaccuugagagccaucaccagcgacuaugucguaguggguaaagcucccucuucggagggagcaucaagg

SEQ ID NO: 2278 - RNA, 89 nt, Artificial Sequence
  gNA Variant Scaffold
acuggcgcuguuaucugauuacuuugagagccaucaccagcgacuaugucguaguggguaaagcucccucuucggagggagcaucaaag

SEQ ID NO: 2279 - RNA, 89 nt, Artificial Sequence
  gNA Variant Scaffold
acuggcgcuuuuaucugauuacuuugagagccaucaccagcgacuaugucguaguggguaaagcucccucuucggagggagcaucgaag

SEQ ID NO: 2280 - RNA, 89 nt, Artificial Sequence
  gNA Variant Scaffold
acuggcgcuuuuaucugauuacuucgagagccaucaccagcgacuaugucguaguggguaaagcucccucuucggagggagcaucaaag

SEQ ID NO: 2281 - RNA, 20 nt, Artificial Sequence
  spacer sequence
ucuuuuuuuuucaaacuuuu

SEQ ID NO: 2282 - RNA, 20 nt, Artificial Sequence
  spacer sequence
uuuuuuuucaaacuuuuuug

SEQ ID NO: 2283 - RNA, 20 nt, Artificial Sequence
  spacer sequence
aacuuuuuuguuuuugauua

SEQ ID NO: 2284 - RNA, 20 nt, Artificial Sequence
  spacer sequence
aaaacaaaaaaguuugaaaa

SEQ ID NO: 2285 - RNA, 20 nt, Artificial Sequence
  spacer sequence
acaguacaaagcugucauga

SEQ ID NO: 2286 - RNA, 20 nt, Artificial Sequence
  spacer sequence
ugaauaauaucuguacaauu

SEQ ID NO: 2287 - RNA, 20 nt, Artificial Sequence
  spacer sequence
ugacagcuuuguacugugga

SEQ ID NO: 2288 - RNA, 20 nt, Artificial Sequence
  spacer sequence
guacaauugaacaguuucaa

SEQ ID NO: 2289 - RNA, 20 nt, Artificial Sequence
  spacer sequence
auuguacagauauuauucau

SEQ ID NO: 2290 - RNA, 20 nt, Artificial Sequence
  spacer sequence
auagcuguucagacacaaau

SEQ ID NO: 2291 - RNA, 20 nt, Artificial Sequence
  spacer sequence
gacacaaauuuauuucaaac

SEQ ID NO: 2292 - RNA, 20 nt, Artificial Sequence
  spacer sequence
gaacagcuauugaaacuguu

SEQ ID NO: 2293 - RNA, 20 nt, Artificial Sequence
  spacer sequence
aacaaauaauuggcaaacau

SEQ ID NO: 2294 - RNA, 20 nt, Artificial Sequence
  spacer sequence
aacuuguaguuaauuauguu

SEQ ID NO: 2295 - RNA, 20 nt, Artificial Sequence
  spacer sequence
aauucuaacuuguaguuaau

SEQ ID NO: 2296 - RNA, 20 nt, Artificial Sequence
  spacer sequence
cagugcuuuaaaacauuaau

SEQ ID NO: 2297 - RNA, 20 nt, Artificial Sequence
  spacer sequence
auuaugguuagcaaaauaaa

SEQ ID NO: 2298 - RNA, 20 nt, Artificial Sequence
  spacer sequence
agaguauggcugggaauuua

SEQ ID NO: 2299 - RNA, 20 nt, Artificial Sequence
  spacer sequence
ggacuuuauuuugcuaacca

SEQ ID NO: 2300 - RNA, 20 nt, Artificial Sequence
  spacer sequence
cagccauacucuggacuuua

SEQ ID NO: 2301 - RNA, 20 nt, Artificial Sequence
  spacer sequence
cagaaagucagaauuccuug

SEQ ID NO: 2302 - RNA, 20 nt, Artificial Sequence
  spacer sequence
gggauuauaauaguaaauuc

SEQ ID NO: 2303 - RNA, 20 nt, Artificial Sequence
  spacer sequence
gaauuccuugggugccaaag

SEQ ID NO: 2304 - RNA, 20 nt, Artificial Sequence
  spacer sequence
gacuuucugggauuauaaua

SEQ ID NO: 2305 - RNA, 20 nt, Artificial Sequence
  spacer sequence
uugggugccaaagucccuug

SEQ ID NO: 2306 - RNA, 20 nt, Artificial Sequence
  spacer sequence
cuugcuauaauuuaguagga

SEQ ID NO: 2307 - RNA, 20 nt, Artificial Sequence
  spacer sequence
uacuaaauuauagcaaggga

SEQ ID NO: 2308 - RNA, 20 nt, Artificial Sequence
  spacer sequence
aagguuguguacauauucaa

SEQ ID NO: 2309 - RNA, 20 nt, Artificial Sequence
  spacer sequence
aaggccaugaucucccaagg

SEQ ID NO: 2310 - RNA, 20 nt, Artificial Sequence
  spacer sequence
uggccuuugaauauguacac

SEQ ID NO: 2311 - RNA, 20 nt, Artificial Sequence
  spacer sequence
cccaaggaacaagggggacu

SEQ ID NO: 2312 - RNA, 20 nt, Artificial Sequence
  spacer sequence
caaggaacaagggggacuuc

SEQ ID NO: 2313 - RNA, 20 nt, Artificial Sequence
  spacer sequence
uugggagaucauggccuuug

SEQ ID NO: 2314 - RNA, 20 nt, Artificial Sequence
  spacer sequence
cccuuguuccuugggagauc

SEQ ID NO: 2315 - RNA, 20 nt, Artificial Sequence
  spacer sequence
auauuaaacaagcaaaaaca

SEQ ID NO: 2316 - RNA, 20 nt, Artificial Sequence
  spacer sequence
auucauucauuccgaauugu

SEQ ID NO: 2317 - RNA, 20 nt, Artificial Sequence
  spacer sequence
uucauuccgaauugucuccu

SEQ ID NO: 2318 - RNA, 20 nt, Artificial Sequence
  spacer sequence
uuccgaauugucuccuccuc

SEQ ID NO: 2319 - RNA, 20 nt, Artificial Sequence
  spacer sequence
gaauugucuccuccucugcc

SEQ ID NO: 2320 - RNA, 20 nt, Artificial Sequence
  spacer sequence
gaaugaaugaauagauuuuu

SEQ ID NO: 2321 - RNA, 20 nt, Artificial Sequence
  spacer sequence
ccuccucugccccuaccuuc

SEQ ID NO: 2322 - RNA, 20 nt, Artificial Sequence
  spacer sequence
uccucugccccuaccuuccc

SEQ ID NO: 2323 - RNA, 20 nt, Artificial Sequence
  spacer sequence
ucugccccuaccuucccccu

SEQ ID NO: 2324 - RNA, 20 nt, Artificial Sequence
  spacer sequence
gccccuaccuucccccuggg

SEQ ID NO: 2325 - RNA, 20 nt, Artificial Sequence
  spacer sequence
cccugggcuuuccugagcag

SEQ ID NO: 2326 - RNA, 20 nt, Artificial Sequence
  spacer sequence
ugagcaguuugauauugaag

SEQ ID NO: 2327 - RNA, 20 nt, Artificial Sequence
  spacer sequence
ggaaagcccagggggaaggu

SEQ ID NO: 2328 - RNA, 20 nt, Artificial Sequence
  spacer sequence
aacugcucaggaaagcccag

SEQ ID NO: 2329 - RNA, 20 nt, Artificial Sequence
  spacer sequence
auaucaaacugcucaggaaa

SEQ ID NO: 2330 - RNA, 20 nt, Artificial Sequence
  spacer sequence
uacaacuucaauaucaaacu

SEQ ID NO: 2331 - RNA, 20 nt, Artificial Sequence
  spacer sequence
uccuacaacuucaauaucaa

SEQ ID NO: 2332 - RNA, 20 nt, Artificial Sequence
  spacer sequence
uuucguccuacaacuucaau

SEQ ID NO: 2333 - RNA, 20 nt, Artificial Sequence
  spacer sequence
aaacuaaaucacuuucacaa

SEQ ID NO: 2334 - RNA, 20 nt, Artificial Sequence
  spacer sequence
cuuucacaaccaccaucaag

SEQ ID NO: 2335 - RNA, 20 nt, Artificial Sequence
  spacer sequence
caaccaccaucaagcuuaca

SEQ ID NO: 2336 - RNA, 20 nt, Artificial Sequence
  spacer sequence
agcuuacaacaucugccuua

SEQ ID NO: 2337 - RNA, 20 nt, Artificial Sequence
  spacer sequence
gccuuaugaauggagguuua

SEQ ID NO: 2338 - RNA, 20 nt, Artificial Sequence
  spacer sequence
uaaggcagauguuguaagcu

SEQ ID NO: 2339 - RNA, 20 nt, Artificial Sequence
  spacer sequence
auucauaaggcagauguugu

SEQ ID NO: 2340 - RNA, 20 nt, Artificial Sequence
  spacer sequence
aagcguaaacaauaaaccuc

SEQ ID NO: 2341 - RNA, 20 nt, Artificial Sequence
  spacer sequence
caaagcguaaacaauaaacc

SEQ ID NO: 2342 - RNA, 20 nt, Artificial Sequence
  spacer sequence
acuucucaaaaacauaaauu

SEQ ID NO: 2343 - RNA, 20 nt, Artificial Sequence
  spacer sequence
caaaaacauaaauuaguaac

SEQ ID NO: 2344 - RNA, 20 nt, Artificial Sequence
  spacer sequence
aaaacauaaauuaguaacau

SEQ ID NO: 2345 - RNA, 20 nt, Artificial Sequence
  spacer sequence
cauguuacuaauuuauguuu

SEQ ID NO: 2346 - RNA, 20 nt, Artificial Sequence
  spacer sequence
uucccauguuacuaauuuau

SEQ ID NO: 2347 - RNA, 20 nt, Artificial Sequence
  spacer sequence
uuccuucccauguuacuaau

SEQ ID NO: 2348 - RNA, 20 nt, Artificial Sequence
  spacer sequence
uaaaaaaaauccuuccuucc

SEQ ID NO: 2349 - RNA, 20 nt, Artificial Sequence
  spacer sequence
auaaaucacauacacacaca

SEQ ID NO: 2350 - RNA, 20 nt, Artificial Sequence
  spacer sequence
aguuggcuuugcuuuuuuag

SEQ ID NO: 2351 - RNA, 20 nt, Artificial Sequence
  spacer sequence
cauacacacacauugauccc

SEQ ID NO: 2352 - RNA, 20 nt, Artificial Sequence
  spacer sequence
auguguguguaugugauuua

SEQ ID NO: 2353 - RNA, 20 nt, Artificial Sequence
  spacer sequence
ccacaccguucucaaugcaa

SEQ ID NO: 2354 - RNA, 20 nt, Artificial Sequence
  spacer sequence
caaugcaaaggacaaaucgg

SEQ ID NO: 2355 - RNA, 20 nt, Artificial Sequence
  spacer sequence
augcaaaggacaaaucggag

SEQ ID NO: 2356 - RNA, 20 nt, Artificial Sequence
  spacer sequence
uuugcauugagaacggugug

SEQ ID NO: 2357 - RNA, 20 nt, Artificial Sequence
  spacer sequence
gagcccaaggaccuucccuu

SEQ ID NO: 2358 - RNA, 20 nt, Artificial Sequence
  spacer sequence
gauuuguccuuugcauugag

SEQ ID NO: 2359 - RNA, 20 nt, Artificial Sequence
  spacer sequence
uugggcuccgauuuguccuu

SEQ ID NO: 2360 - RNA, 20 nt, Artificial Sequence
  spacer sequence
cuuuaguaguagagcaugcu

SEQ ID NO: 2361 - RNA, 20 nt, Artificial Sequence
  spacer sequence
acuacuaaagggaagguccu

SEQ ID NO: 2362 - RNA, 20 nt, Artificial Sequence
  spacer sequence
acaggaagagguuuaauuua

SEQ ID NO: 2363 - RNA, 20 nt, Artificial Sequence
  spacer sequence
uguggaagcaugcucuacua

SEQ ID NO: 2364 - RNA, 20 nt, Artificial Sequence
  spacer sequence
uccuguggaagcaugcucua

SEQ ID NO: 2365 - RNA, 20 nt, Artificial Sequence
  spacer sequence
uauaaauuaaaccucuuccu

SEQ ID NO: 2366 - RNA, 20 nt, Artificial Sequence
  spacer sequence
uuuaaaaugcuauugauggc

SEQ ID NO: 2367 - RNA, 20 nt, Artificial Sequence
  spacer sequence
auagcauuuuaaaggaccaa

SEQ ID NO: 2368 - RNA, 20 nt, Artificial Sequence
  spacer sequence
caaaguaaucccagcacuuu

SEQ ID NO: 2369 - RNA, 20 nt, Artificial Sequence
  spacer sequence
cagcacuuugggagccugag

SEQ ID NO: 2370 - RNA, 20 nt, Artificial Sequence
  spacer sequence
caaagugcugggauuacuuu

SEQ ID NO: 2371 - RNA, 20 nt, Artificial Sequence
  spacer sequence
ggcucccaaagugcugggau

SEQ ID NO: 2372 - RNA, 20 nt, Artificial Sequence
  spacer sequence
gccugccucaggcucccaaa

SEQ ID NO: 2373 - RNA, 20 nt, Artificial Sequence
  spacer sequence
caaggucuggaguucgagac

SEQ ID NO: 2374 - RNA, 20 nt, Artificial Sequence
  spacer sequence
ggaguucgagaccaguucgg

SEQ ID NO: 2375 - RNA, 20 nt, Artificial Sequence
  spacer sequence
agaccuugugauccgccugc

SEQ ID NO: 2376 - RNA, 20 nt, Artificial Sequence
  spacer sequence
agaccaguucggucaauaua

SEQ ID NO: 2377 - RNA, 20 nt, Artificial Sequence
  spacer sequence
aacuccagaccuugugaucc

SEQ ID NO: 2378 - RNA, 20 nt, Artificial Sequence
  spacer sequence
cgaacuccagaccuugugau

SEQ ID NO: 2379 - RNA, 20 nt, Artificial Sequence
  spacer sequence
gucaauauagugaaaccccg

SEQ ID NO: 2380 - RNA, 20 nt, Artificial Sequence
  spacer sequence
auauagugaaaccccgucuc

SEQ ID NO: 2381 - RNA, 20 nt, Artificial Sequence
  spacer sequence
cuauauugaccgaacugguc

SEQ ID NO: 2382 - RNA, 20 nt, Artificial Sequence
  spacer sequence
cuauuaaaaaugcaaaaauu

SEQ ID NO: 2383 - RNA, 20 nt, Artificial Sequence
  spacer sequence
auuaaaaaugcaaaaauuag

SEQ ID NO: 2384 - RNA, 20 nt, Artificial Sequence
  spacer sequence
cagcuacuugggaggcugag

SEQ ID NO: 2385 - RNA, 20 nt, Artificial Sequence
  spacer sequence
caaguagcugggacuacagg

SEQ ID NO: 2386 - RNA, 20 nt, Artificial Sequence
  spacer sequence
gccucccaaguagcugggac

SEQ ID NO: 2387 - RNA, 20 nt, Artificial Sequence
  spacer sequence
ugccucagccucccaaguag

SEQ ID NO: 2388 - RNA, 20 nt, Artificial Sequence
  spacer sequence
ccugccucagccucccaagu

SEQ ID NO: 2389 - RNA, 20 nt, Artificial Sequence
  spacer sequence
cuugaaccuggaggugagga

SEQ ID NO: 2390 - RNA, 20 nt, Artificial Sequence
  spacer sequence
agugauucuccugccucagc

SEQ ID NO: 2391 - RNA, 20 nt, Artificial Sequence
  spacer sequence
agguucaagugauucuccug

SEQ ID NO: 2392 - RNA, 20 nt, Artificial Sequence
  spacer sequence
ccuccagguucaagugauuc

SEQ ID NO: 2393 - RNA, 20 nt, Artificial Sequence
  spacer sequence
ucaccuccagguucaaguga

SEQ ID NO: 2394 - RNA, 20 nt, Artificial Sequence
  spacer sequence
cugcaaccuccucaccucca

SEQ ID NO: 2395 - RNA, 20 nt, Artificial Sequence
  spacer sequence
gagauugcgccacugcacuc

SEQ ID NO: 2396 - RNA, 20 nt, Artificial Sequence
  spacer sequence
gaucgcugcaaccuccucac

SEQ ID NO: 2397 - RNA, 20 nt, Artificial Sequence
  spacer sequence
cagaucgcugcaaccuccuc

SEQ ID NO: 2398 - RNA, 20 nt, Artificial Sequence
  spacer sequence
agcccgggcuacaaugcgag

SEQ ID NO: 2399 - RNA, 20 nt, Artificial Sequence
  spacer sequence
cauuguagcccgggcuggag

SEQ ID NO: 2400 - RNA, 20 nt, Artificial Sequence
  spacer sequence
cgcauuguagcccgggcugg

SEQ ID NO: 2401 - RNA, 20 nt, Artificial Sequence
  spacer sequence
gucucaaaaaaaaaaaaaag

SEQ ID NO: 2402 - RNA, 20 nt, Artificial Sequence
  spacer sequence
caaaaaaaaaaaaaaguuau

SEQ ID NO: 2403 - RNA, 20 nt, Artificial Sequence
  spacer sequence
aaaaaaaaaaaaaguuauug

SEQ ID NO: 2404 - RNA, 20 nt, Artificial Sequence
  spacer sequence
auaacuuuuuuuuuuuuuug

SEQ ID NO: 2405 - RNA, 20 nt, Artificial Sequence
  spacer sequence
uugaucuuuggaaacaacgg

SEQ ID NO: 2406 - RNA, 20 nt, Artificial Sequence
  spacer sequence
aggaaugucaauaacuuuuu

SEQ ID NO: 2407 - RNA, 20 nt, Artificial Sequence
  spacer sequence
uuggaaacaacggcaaaggg

SEQ ID NO: 2408 - RNA, 20 nt, Artificial Sequence
  spacer sequence
aaagaucaaggaaugucaau

SEQ ID NO: 2409 - RNA, 20 nt, Artificial Sequence
  spacer sequence
aaccuaauauugaauaaggg

SEQ ID NO: 2410 - RNA, 20 nt, Artificial Sequence
  spacer sequence
auauuagguuugauuugccc

SEQ ID NO: 2411 - RNA, 20 nt, Artificial Sequence
  spacer sequence
cuuauucaauauuagguuug

SEQ ID NO: 2412 - RNA, 20 nt, Artificial Sequence
  spacer sequence
cccuuauucaauauuagguu

SEQ ID NO: 2413 - RNA, 20 nt, Artificial Sequence
  spacer sequence
uucucccuuauucaauauua

SEQ ID NO: 2414 - RNA, 20 nt, Artificial Sequence
  spacer sequence
aguuggcacuccuucucccu

SEQ ID NO: 2415 - RNA, 20 nt, Artificial Sequence
  spacer sequence
uuuccaugcacugucagggu

SEQ ID NO: 2416 - RNA, 20 nt, Artificial Sequence
  spacer sequence
augcacugucagggugauag

SEQ ID NO: 2417 - RNA, 20 nt, Artificial Sequence
  spacer sequence
gggugauagugccagaugcc

SEQ ID NO: 2418 - RNA, 20 nt, Artificial Sequence
  spacer sequence
cccugacagugcauggaaag

SEQ ID NO: 2419 - RNA, 20 nt, Artificial Sequence
  spacer sequence
ggcacuaucacccugacagu

SEQ ID NO: 2420 - RNA, 20 nt, Artificial Sequence
  spacer sequence
uuuccaugcaccaucaggga

SEQ ID NO: 2421 - RNA, 20 nt, Artificial Sequence
  spacer sequence
augcaccaucagggagacag

SEQ ID NO: 2422 - RNA, 20 nt, Artificial Sequence
  spacer sequence
gggagacagugccauuuaca

SEQ ID NO: 2423 - RNA, 20 nt, Artificial Sequence
  spacer sequence
cugauggugcauggaaagga

SEQ ID NO: 2424 - RNA, 20 nt, Artificial Sequence
  spacer sequence
cccugauggugcauggaaag

SEQ ID NO: 2425 - RNA, 20 nt, Artificial Sequence
  spacer sequence
ggaguacucgggagcuuuga

SEQ ID NO: 2426 - RNA, 20 nt, Artificial Sequence
  spacer sequence
cgaguacacagcccaaaugu

SEQ ID NO: 2427 - RNA, 20 nt, Artificial Sequence
  spacer sequence
ggagcuuugagaaccugcug

SEQ ID NO: 2428 - RNA, 20 nt, Artificial Sequence
  spacer sequence
cgaguacucccgaguacaca

SEQ ID NO: 2429 - RNA, 20 nt, Artificial Sequence
  spacer sequence
aagcucccgaguacucccga

SEQ ID NO: 2430 - RNA, 20 nt, Artificial Sequence
  spacer sequence
caaagcucccgaguacuccc

SEQ ID NO: 2431 - RNA, 20 nt, Artificial Sequence
  spacer sequence
gcagguucucaaagcucccg

SEQ ID NO: 2432 - RNA, 20 nt, Artificial Sequence
  spacer sequence
cgugcugcugcggccucagc

SEQ ID NO: 2433 - RNA, 20 nt, Artificial Sequence
  spacer sequence
ggugucacgugcugcugcgg

SEQ ID NO: 2434 - RNA, 20 nt, Artificial Sequence
  spacer sequence
cuggugucacgugcugcugc

SEQ ID NO: 2435 - RNA, 20 nt, Artificial Sequence
  spacer sequence
ucucuggugucacgugcugc

SEQ ID NO: 2436 - RNA, 20 nt, Artificial Sequence
  spacer sequence
caccccagucaucucuggug

SEQ ID NO: 2437 - RNA, 20 nt, Artificial Sequence
  spacer sequence
uggacuugaggcuuuacacc

SEQ ID NO: 2438 - RNA, 20 nt, Artificial Sequence
  spacer sequence
augaaucccaccccagucau

SEQ ID NO: 2439 - RNA, 20 nt, Artificial Sequence
  spacer sequence
aguccaugaaucccacccca

SEQ ID NO: 2440 - RNA, 20 nt, Artificial Sequence
  spacer sequence
uaagugguguaaagccucaa

SEQ ID NO: 2441 - RNA, 20 nt, Artificial Sequence
  spacer sequence
ccucagcauggaccucugaa

SEQ ID NO: 2442 - RNA, 20 nt, Artificial Sequence
  spacer sequence
gcauggaccucugaaccagc

SEQ ID NO: 2443 - RNA, 20 nt, Artificial Sequence
  spacer sequence
augcugaggggagggcacuc

SEQ ID NO: 2444 - RNA, 20 nt, Artificial Sequence
  spacer sequence
gaaccagccugaccugaccu

SEQ ID NO: 2445 - RNA, 20 nt, Artificial Sequence
  spacer sequence
gagguccaugcugaggggag

SEQ ID NO: 2446 - RNA, 20 nt, Artificial Sequence
  spacer sequence
ggcugguucagagguccaug

SEQ ID NO: 2447 - RNA, 20 nt, Artificial Sequence
  spacer sequence
ggucaggcugguucagaggu

SEQ ID NO: 2448 - RNA, 20 nt, Artificial Sequence
  spacer sequence
aacacaccagcgggcccugc

SEQ ID NO: 2449 - RNA, 20 nt, Artificial Sequence
  spacer sequence
ggcagggcccgcuggugugu

SEQ ID NO: 2450 - RNA, 20 nt, Artificial Sequence
  spacer sequence
uugccaagguucuggcaggg

SEQ ID NO: 2451 - RNA, 20 nt, Artificial Sequence
  spacer sequence
uguccuugccaagguucugg

SEQ ID NO: 2452 - RNA, 20 nt, Artificial Sequence
  spacer sequence
ugcauccuguccuugccaag

SEQ ID NO: 2453 - RNA, 20 nt, Artificial Sequence
  spacer sequence
agagccaggacagcccguca

SEQ ID NO: 2454 - RNA, 20 nt, Artificial Sequence
  spacer sequence
ggaauucaugcauccugucc

SEQ ID NO: 2455 - RNA, 20 nt, Artificial Sequence
  spacer sequence
uggcucuggaauucaugcau

SEQ ID NO: 2456 - RNA, 20 nt, Artificial Sequence
  spacer sequence
auagggccuuauuauuuccc

SEQ ID NO: 2457 - RNA, 20 nt, Artificial Sequence
  spacer sequence
ccuucccagggccacaacug

SEQ ID NO: 2458 - RNA, 20 nt, Artificial Sequence
  spacer sequence
cagggccacaacugcacaga

SEQ ID NO: 2459 - RNA, 20 nt, Artificial Sequence
  spacer sequence
gugcaguuguggcccuggga

SEQ ID NO: 2460 - RNA, 20 nt, Artificial Sequence
  spacer sequence
uuauucugugcaguuguggc

SEQ ID NO: 2461 - RNA, 20 nt, Artificial Sequence
  spacer sequence
aaaaucauuauucugugcag

SEQ ID NO: 2462 - RNA, 20 nt, Artificial Sequence
  spacer sequence
cugucaaaaaucauuauucu

SEQ ID NO: 2463 - RNA, 20 nt, Artificial Sequence
  spacer sequence
uuuggcuucacugucaaaaa

SEQ ID NO: 2464 - RNA, 20 nt, Artificial Sequence
  spacer sequence
cguaguauucauuuggcuuc

SEQ ID NO: 2465 - RNA, 20 nt, Artificial Sequence
  spacer sequence
cuucccguaguauucauuug

SEQ ID NO: 2466 - RNA, 20 nt, Artificial Sequence
  spacer sequence
ggaguacuuaugagaaaaag

SEQ ID NO: 2467 - RNA, 20 nt, Artificial Sequence
  spacer sequence
ugaguacuaguggucacuuc

SEQ ID NO: 2468 - RNA, 20 nt, Artificial Sequence
  spacer sequence
uaaguacuccugaguacuag

SEQ ID NO: 2469 - RNA, 20 nt, Artificial Sequence
  spacer sequence
cauaaguacuccugaguacu

SEQ ID NO: 2470 - RNA, 20 nt, Artificial Sequence
  spacer sequence
uuuucucauaaguacuccug

SEQ ID NO: 2471 - RNA, 20 nt, Artificial Sequence
  spacer sequence
uauucuuuuucucauaagua

SEQ ID NO: 2472 - RNA, 20 nt, Artificial Sequence
  spacer sequence
cuauuguauaauauauacug

SEQ ID NO: 2473 - RNA, 20 nt, Artificial Sequence
  spacer sequence
auuguauaauauauacugua

SEQ ID NO: 2474 - RNA, 20 nt, Artificial Sequence
  spacer sequence
uguucaacuuuagaaauuac

SEQ ID NO: 2475 - RNA, 20 nt, Artificial Sequence
  spacer sequence
acuuuagaaauuacauuuua

SEQ ID NO: 2476 - RNA, 20 nt, Artificial Sequence
  spacer sequence
aaaguugaacaugaauguuu

SEQ ID NO: 2477 - RNA, 20 nt, Artificial Sequence
  spacer sequence
uguuuuaaaauguaauuucu

SEQ ID NO: 2478 - RNA, 20 nt, Artificial Sequence
  spacer sequence
ccuuaaaaacacacacaaac

SEQ ID NO: 2479 - RNA, 20 nt, Artificial Sequence
  spacer sequence
uuaaaaacacacacaaacca

SEQ ID NO: 2480 - RNA, 20 nt, Artificial Sequence
  spacer sequence
uugugugugugguuugugug

SEQ ID NO: 2481 - RNA, 20 nt, Artificial Sequence
  spacer sequence
uacaguguuuuuauuuuguu

SEQ ID NO: 2482 - RNA, 20 nt, Artificial Sequence
  spacer sequence
ugcaguauuccuacaguguu

SEQ ID NO: 2483 - RNA, 20 nt, Artificial Sequence
  spacer sequence
agguaauccacaucaacccu

SEQ ID NO: 2484 - RNA, 20 nt, Artificial Sequence
  spacer sequence
acaucaacccugguaucagg

SEQ ID NO: 2485 - RNA, 20 nt, Artificial Sequence
  spacer sequence
acccugguaucagguucuug

SEQ ID NO: 2486 - RNA, 20 nt, Artificial Sequence
  spacer sequence
gguucuugaguccaguccau

SEQ ID NO: 2487 - RNA, 20 nt, Artificial Sequence
  spacer sequence
ugaguccaguccauggcuaa

SEQ ID NO: 2488 - RNA, 20 nt, Artificial Sequence
  spacer sequence
agaaccugauaccaggguug

SEQ ID NO: 2489 - RNA, 20 nt, Artificial Sequence
  spacer sequence
aguccauggcuaagcgcgaa

SEQ ID NO: 2490 - RNA, 20 nt, Artificial Sequence
  spacer sequence
auggcuaagcgcgaacacac

SEQ ID NO: 2491 - RNA, 20 nt, Artificial Sequence
  spacer sequence
cgcuuagccauggacuggac

SEQ ID NO: 2492 - RNA, 20 nt, Artificial Sequence
  spacer sequence
guauuagugucucaagugca

SEQ ID NO: 2493 - RNA, 20 nt, Artificial Sequence
  spacer sequence
caagugcagggggcccugac

SEQ ID NO: 2494 - RNA, 20 nt, Artificial Sequence
  spacer sequence
agugcagggggcccugaccc

SEQ ID NO: 2495 - RNA, 20 nt, Artificial Sequence
  spacer sequence
gggcccccugcacuugagac

SEQ ID NO: 2496 - RNA, 20 nt, Artificial Sequence
  spacer sequence
aaguugcuggggucagggcc

SEQ ID NO: 2497 - RNA, 20 nt, Artificial Sequence
  spacer sequence
acaugugaauacaguauuuu

SEQ ID NO: 2498 - RNA, 20 nt, Artificial Sequence
  spacer sequence
cauguagauauaauguacau

SEQ ID NO: 2499 - RNA, 20 nt, Artificial Sequence
  spacer sequence
uaauuuaaaauacuguauuc

SEQ ID NO: 2500 - RNA, 20 nt, Artificial Sequence
  spacer sequence
accaaauaucaggagauggu

SEQ ID NO: 2501 - RNA, 20 nt, Artificial Sequence
  spacer sequence
ggagaugguugcgguucaga

SEQ ID NO: 2502 - RNA, 20 nt, Artificial Sequence
  spacer sequence
ugauauuugguagaguaaca

SEQ ID NO: 2503 - RNA, 20 nt, Artificial Sequence
  spacer sequence
ccugauauuugguagaguaa

SEQ ID NO: 2504 - RNA, 20 nt, Artificial Sequence
  spacer sequence
gagaacaguuaauaaaaggg

SEQ ID NO: 2505 - RNA, 20 nt, Artificial Sequence
  spacer sequence
gaaccgcaaccaucuccuga

SEQ ID NO: 2506 - RNA, 20 nt, Artificial Sequence
  spacer sequence
cugaaccgcaaccaucuccu

SEQ ID NO: 2507 - RNA, 20 nt, Artificial Sequence
  spacer sequence
gcacauguauuccagaacuu

SEQ ID NO: 2508 - RNA, 20 nt, Artificial Sequence
  spacer sequence
agaacuuaaaauauaauuua

SEQ ID NO: 2509 - RNA, 20 nt, Artificial Sequence
  spacer sequence
ggaauacaugugcagaacgu

SEQ ID NO: 2510 - RNA, 20 nt, Artificial Sequence
  spacer sequence
uuuauuuuauuuuuaauuuu

SEQ ID NO: 2511 - RNA, 20 nt, Artificial Sequence
  spacer sequence
caacauagcucuuuuauuuu

SEQ ID NO: 2512 - RNA, 20 nt, Artificial Sequence
  spacer sequence
cccaacauagcucuuuuauu

SEQ ID NO: 2513 - RNA, 20 nt, Artificial Sequence
  spacer sequence
guuauuaucucccaacauag

SEQ ID NO: 2514 - RNA, 20 nt, Artificial Sequence
  spacer sequence
uuuuuuuuuuuuuuuuuuuu

SEQ ID NO: 2515 - RNA, 20 nt, Artificial Sequence
  spacer sequence
aaaaaaaaaaaaaaaaaaaa

SEQ ID NO: 2516 - RNA, 20 nt, Artificial Sequence
  spacer sequence
caaaaaaaaaaaaaaaaaaa

SEQ ID NO: 2517 - RNA, 20 nt, Artificial Sequence
  spacer sequence
gucucaaaaaaaaaaaaaaa

SEQ ID NO: 2518 - RNA, 20 nt, Artificial Sequence
  spacer sequence
cgcucugucgcccaggcugg

SEQ ID NO: 2519 - RNA, 20 nt, Artificial Sequence
  spacer sequence
cucugucgcccaggcuggag

SEQ ID NO: 2520 - RNA, 20 nt, Artificial Sequence
  spacer sequence
gucgcccaggcuggagugca

SEQ ID NO: 2521 - RNA, 20 nt, Artificial Sequence
  spacer sequence
cccaggcuggagugcagugg

SEQ ID NO: 2522 - RNA, 20 nt, Artificial Sequence
  spacer sequence
agccugggcgacagagcgag

SEQ ID NO: 2523 - RNA, 20 nt, Artificial Sequence
  spacer sequence
ugacucacugcaaccuccgc

SEQ ID NO: 2524 - RNA, 20 nt, Artificial Sequence
  spacer sequence
agauugcaccacugcacucc

SEQ ID NO: 2525 - RNA, 20 nt, Artificial Sequence
  spacer sequence
cugcaaccuccgccuccagg

SEQ ID NO: 2526 - RNA, 20 nt, Artificial Sequence
  spacer sequence
gccuccaggguucuggccau

SEQ ID NO: 2527 - RNA, 20 nt, Artificial Sequence
  spacer sequence
aggguucuggccauucuccu

SEQ ID NO: 2528 - RNA, 20 nt, Artificial Sequence
  spacer sequence
ggccauucuccugccucagc

SEQ ID NO: 2529 - RNA, 20 nt, Artificial Sequence
  spacer sequence
ccugccucagccucccaagu

SEQ ID NO: 2530 - RNA, 20 nt, Artificial Sequence
  spacer sequence
ugccucagccucccaaguag

SEQ ID NO: 2531 - RNA, 20 nt, Artificial Sequence
  spacer sequence
gccucccaaguagcugggac

SEQ ID NO: 2532 - RNA, 20 nt, Artificial Sequence
  spacer sequence
caaguagcugggacuagagg

SEQ ID NO: 2533 - RNA, 20 nt, Artificial Sequence
  spacer sequence
cagcuacuugggaggcugag

SEQ ID NO: 2534 - RNA, 20 nt, Artificial Sequence
  spacer sequence
agucccagcuacuugggagg

SEQ ID NO: 2535 - RNA, 20 nt, Artificial Sequence
  spacer sequence
acuaaaaauacaaaaaauua

SEQ ID NO: 2536 - RNA, 20 nt, Artificial Sequence
  spacer sequence
cuacuaaaaauacaaaaaau

SEQ ID NO: 2537 - RNA, 20 nt, Artificial Sequence
  spacer sequence
ccguguuagccaggaugguc

SEQ ID NO: 2538 - RNA, 20 nt, Artificial Sequence
  spacer sequence
uggcuaacacggugaaaccc

SEQ ID NO: 2539 - RNA, 20 nt, Artificial Sequence
  spacer sequence
caaucuccugaccucgugau

SEQ ID NO: 2540 - RNA, 20 nt, Artificial Sequence
  spacer sequence
aucuccugaccucgugaucc

SEQ ID NO: 2541 - RNA, 20 nt, Artificial Sequence
  spacer sequence
ccugaccucgugauccgccc

SEQ ID NO: 2542 - RNA, 20 nt, Artificial Sequence
  spacer sequence
ugaccucgugauccgcccgc

SEQ ID NO: 2543 - RNA, 20 nt, Artificial Sequence
  spacer sequence
ggagauugagaccauccugg

SEQ ID NO: 2544 - RNA, 20 nt, Artificial Sequence
  spacer sequence
ugauccgcccgccuuggcuu

SEQ ID NO: 2545 - RNA, 20 nt, Artificial Sequence
  spacer sequence
cgaggucaggagauugagac

SEQ ID NO: 2546 - RNA, 20 nt, Artificial Sequence
  spacer sequence
gcccgccuuggcuuuccaaa

SEQ ID NO: 2547 - RNA, 20 nt, Artificial Sequence
  spacer sequence
aaagugcugggauuacaggg

SEQ ID NO: 2548 - RNA, 20 nt, Artificial Sequence
  spacer sequence
cagcacuuuggaaagccaag

SEQ ID NO: 2549 - RNA, 20 nt, Artificial Sequence
  spacer sequence
ccccuguaaucccagcacuu

SEQ ID NO: 2550 - RNA, 20 nt, Artificial Sequence
  spacer sequence
gccaacugacuuacaguucu

SEQ ID NO: 2551 - RNA, 20 nt, Artificial Sequence
  spacer sequence
guuggccgagcgcaguggcu

SEQ ID NO: 2552 - RNA, 20 nt, Artificial Sequence
  spacer sequence
uuaaauuaaaagaaauuggu

SEQ ID NO: 2553 - RNA, 20 nt, Artificial Sequence
  spacer sequence
uuuaauuuaaagaacuguaa

SEQ ID NO: 2554 - RNA, 20 nt, Artificial Sequence
  spacer sequence
auaccaauuucuuuuaauuu

SEQ ID NO: 2555 - RNA, 20 nt, Artificial Sequence
  spacer sequence
uuucuauaccaauuucuuuu

SEQ ID NO: 2556 - RNA, 20 nt, Artificial Sequence
  spacer sequence
aaaacauauuacuaaaacga

SEQ ID NO: 2557 - RNA, 20 nt, Artificial Sequence
  spacer sequence
uuuuaguaauauguuuugga

SEQ ID NO: 2558 - RNA, 20 nt, Artificial Sequence
  spacer sequence
gggucguuuuaguaauaugu

SEQ ID NO: 2559 - RNA, 20 nt, Artificial Sequence
  spacer sequence
cugggucguuuuaguaauau

SEQ ID NO: 2560 - RNA, 20 nt, Artificial Sequence
  spacer sequence
cucugggucguuuuaguaau

SEQ ID NO: 2561 - RNA, 20 nt, Artificial Sequence
  spacer sequence
auuguccaacauguuccuaa

SEQ ID NO: 2562 - RNA, 20 nt, Artificial Sequence
  spacer sequence
aacauguuccuaauacagca

SEQ ID NO: 2563 - RNA, 20 nt, Artificial Sequence
  spacer sequence
uaauacagcaagucaaaauu

SEQ ID NO: 2564 - RNA, 20 nt, Artificial Sequence
  spacer sequence
aaauucauaaugacuuggac

SEQ ID NO: 2565 - RNA, 20 nt, Artificial Sequence
  spacer sequence
uaaugacuuggacggucaaa

SEQ ID NO: 2566 - RNA, 20 nt, Artificial Sequence
  spacer sequence
uuaugaauuuugacuugcug

SEQ ID NO: 2567 - RNA, 20 nt, Artificial Sequence
  spacer sequence
aagucauuaugaauuuugac

SEQ ID NO: 2568 - RNA, 20 nt, Artificial Sequence
  spacer sequence
aaaggagaauguuaacuuuu

SEQ ID NO: 2569 - RNA, 20 nt, Artificial Sequence
  spacer sequence
uuuugaccguccaagucauu

SEQ ID NO: 2570 - RNA, 20 nt, Artificial Sequence
  spacer sequence
ccuuuugaccguccaaguca

SEQ ID NO: 2571 - RNA, 20 nt, Artificial Sequence
  spacer sequence
aaaguuaacauucuccuuuu

SEQ ID NO: 2572 - RNA, 20 nt, Artificial Sequence
  spacer sequence
uuuucaaaaguuaacauucu

SEQ ID NO: 2573 - RNA, 20 nt, Artificial Sequence
  spacer sequence
acggcuuucauuuucaaaag

SEQ ID NO: 2574 - RNA, 20 nt, Artificial Sequence
  spacer sequence
gaguagguguuuggcaccca

SEQ ID NO: 2575 - RNA, 20 nt, Artificial Sequence
  spacer sequence
gaauguccacggcuuucauu

SEQ ID NO: 2576 - RNA, 20 nt, Artificial Sequence
  spacer sequence
cugaagaagaaugcuguuuc

SEQ ID NO: 2577 - RNA, 20 nt, Artificial Sequence
  spacer sequence
gugaaauuuugggugccaaa

SEQ ID NO: 2578 - RNA, 20 nt, Artificial Sequence
  spacer sequence
ucagugaaauuuugggugcc

SEQ ID NO: 2579 - RNA, 20 nt, Artificial Sequence
  spacer sequence
ucuucagugaaauuuugggu

SEQ ID NO: 2580 - RNA, 20 nt, Artificial Sequence
  spacer sequence
uaguaucaaaccaaagugca

SEQ ID NO: 2581 - RNA, 20 nt, Artificial Sequence
  spacer sequence
aaccaaagugcaaagcaaua

SEQ ID NO: 2582 - RNA, 20 nt, Artificial Sequence
  spacer sequence
aauuuauauugcuuugcacu

SEQ ID NO: 2583 - RNA, 20 nt, Artificial Sequence
  spacer sequence
uggccucuaauuuauauugc

SEQ ID NO: 2584 - RNA, 20 nt, Artificial Sequence
  spacer sequence
cuuggcgucaauuuacuucu

SEQ ID NO: 2585 - RNA, 20 nt, Artificial Sequence
  spacer sequence
uggcgucaauuuacuucugu

SEQ ID NO: 2586 - RNA, 20 nt, Artificial Sequence
  spacer sequence
auuuacuucuguaaaacaga

SEQ ID NO: 2587 - RNA, 20 nt, Artificial Sequence
  spacer sequence
guaaaacagauucuauguuc

SEQ ID NO: 2588 - RNA, 20 nt, Artificial Sequence
  spacer sequence
guuuuacagaaguaaauuga

SEQ ID NO: 2589 - RNA, 20 nt, Artificial Sequence
  spacer sequence
auguuccuuuucuaugauca

SEQ ID NO: 2590 - RNA, 20 nt, Artificial Sequence
  spacer sequence
uuuucuaugaucaguuuaca

SEQ ID NO: 2591 - RNA, 20 nt, Artificial Sequence
  spacer sequence
augaucaguuuacauuugaa

SEQ ID NO: 2592 - RNA, 20 nt, Artificial Sequence
  spacer sequence
uagaaaaggaacauagaauc

SEQ ID NO: 2593 - RNA, 20 nt, Artificial Sequence
  spacer sequence
guuuacauuugaaacauuag

SEQ ID NO: 2594 - RNA, 20 nt, Artificial Sequence
  spacer sequence
aauguaaacugaucauagaa

SEQ ID NO: 2595 - RNA, 20 nt, Artificial Sequence
  spacer sequence
aauguuucaaauguaaacug

SEQ ID NO: 2596 - RNA, 20 nt, Artificial Sequence
  spacer sequence
cuaaugagggaaggaaaugg

SEQ ID NO: 2597 - RNA, 20 nt, Artificial Sequence
  spacer sequence
uuagugaaaaaaucuaaugu

SEQ ID NO: 2598 - RNA, 20 nt, Artificial Sequence
  spacer sequence
cucauuagugaaaaaaucua

SEQ ID NO: 2599 - RNA, 20 nt, Artificial Sequence
  spacer sequence
uucccucauuagugaaaaaa

SEQ ID NO: 2600 - RNA, 20 nt, Artificial Sequence
  spacer sequence
gugcuacuuucaagucagug

SEQ ID NO: 2601 - RNA, 20 nt, Artificial Sequence
  spacer sequence
agucagugaagcuaaggucu

SEQ ID NO: 2602 - RNA, 20 nt, Artificial Sequence
  spacer sequence
gugaagcuaaggucuccuuc

SEQ ID NO: 2603 - RNA, 20 nt, Artificial Sequence
  spacer sequence
cugacuugaaaguagcacag

SEQ ID NO: 2604 - RNA, 20 nt, Artificial Sequence
  spacer sequence
ccuucucaaaguagagcugg

SEQ ID NO: 2605 - RNA, 20 nt, Artificial Sequence
  spacer sequence
uucucaaaguagagcuggaa

SEQ ID NO: 2606 - RNA, 20 nt, Artificial Sequence
  spacer sequence
caaaguagagcuggaaucag

SEQ ID NO: 2607 - RNA, 20 nt, Artificial Sequence
  spacer sequence
aaguagagcuggaaucagag

SEQ ID NO: 2608 - RNA, 20 nt, Artificial Sequence
  spacer sequence
acuuugagaaggagaccuua

SEQ ID NO: 2609 - RNA, 20 nt, Artificial Sequence
  spacer sequence
agcucuacuuugagaaggag

SEQ ID NO: 2610 - RNA, 20 nt, Artificial Sequence
  spacer sequence
gaggugagaaaugucgggac

SEQ ID NO: 2611 - RNA, 20 nt, Artificial Sequence
  spacer sequence
gauuccagcucuacuuugag

SEQ ID NO: 2612 - RNA, 20 nt, Artificial Sequence
  spacer sequence
ccucugauuccagcucuacu

SEQ ID NO: 2613 - RNA, 20 nt, Artificial Sequence
  spacer sequence
caccucugauuccagcucua

SEQ ID NO: 2614 - RNA, 20 nt, Artificial Sequence
  spacer sequence
ggacuugaagaguuaggcug

SEQ ID NO: 2615 - RNA, 20 nt, Artificial Sequence
  spacer sequence
cgacauuucucaccucugau

SEQ ID NO: 2616 - RNA, 20 nt, Artificial Sequence
  spacer sequence
agucccgacauuucucaccu

SEQ ID NO: 2617 - RNA, 20 nt, Artificial Sequence
  spacer sequence
ucaagucccgacauuucuca

SEQ ID NO: 2618 - RNA, 20 nt, Artificial Sequence
  spacer sequence
acccagcgucuagaaccaau

SEQ ID NO: 2619 - RNA, 20 nt, Artificial Sequence
  spacer sequence
agaaccaauuccagcuucau

SEQ ID NO: 2620 - RNA, 20 nt, Artificial Sequence
  spacer sequence
agacgcuggguagaugcaaa

SEQ ID NO: 2621 - RNA, 20 nt, Artificial Sequence
  spacer sequence
agcuucauaacucagcugug

SEQ ID NO: 2622 - RNA, 20 nt, Artificial Sequence
  spacer sequence
uaacucagcugugaacgaac

SEQ ID NO: 2623 - RNA, 20 nt, Artificial Sequence
  spacer sequence
gcugugaacgaacucccuua

SEQ ID NO: 2624 - RNA, 20 nt, Artificial Sequence
  spacer sequence
cagcugaguuaugaagcugg

SEQ ID NO: 2625 - RNA, 20 nt, Artificial Sequence
  spacer sequence
uucacagcugaguuaugaag

SEQ ID NO: 2626 - RNA, 20 nt, Artificial Sequence
  spacer sequence
cuuaggcauugguagccacg

SEQ ID NO: 2627 - RNA, 20 nt, Artificial Sequence
  spacer sequence
agacuagaaaacccggaaac

SEQ ID NO: 2628 - RNA, 20 nt, Artificial Sequence
  spacer sequence
ugaacuacuggcuacguggc

SEQ ID NO: 2629 - RNA, 20 nt, Artificial Sequence
  spacer sequence
agucuugaacuacuggcuac

SEQ ID NO: 2630 - RNA, 20 nt, Artificial Sequence
  spacer sequence
ggguuuucuagucuugaacu

SEQ ID NO: 2631 - RNA, 20 nt, Artificial Sequence
  spacer sequence
cccguuuccggguuuucuag

SEQ ID NO: 2632 - RNA, 20 nt, Artificial Sequence
  spacer sequence
gcacuuucacccguuuccgg

SEQ ID NO: 2633 - RNA, 20 nt, Artificial Sequence
  spacer sequence
agagauguaaguguauguuc

SEQ ID NO: 2634 - RNA, 20 nt, Artificial Sequence
  spacer sequence
agauaacagucugcacuuuc

SEQ ID NO: 2635 - RNA, 20 nt, Artificial Sequence
  spacer sequence
cuagauaacagucugcacuu

SEQ ID NO: 2636 - RNA, 20 nt, Artificial Sequence
  spacer sequence
ggagggggaaugggucucau

SEQ ID NO: 2637 - RNA, 20 nt, Artificial Sequence
  spacer sequence
agaacauacacuuacaucuc

SEQ ID NO: 2638 - RNA, 20 nt, Artificial Sequence
  spacer sequence
cccuccagaacauacacuua

SEQ ID NO: 2639 - RNA, 20 nt, Artificial Sequence
  spacer sequence
cauucugggcacugggaggc

SEQ ID NO: 2640 - RNA, 20 nt, Artificial Sequence
  spacer sequence
uucugggcacugggaggcac

SEQ ID NO: 2641 - RNA, 20 nt, Artificial Sequence
  spacer sequence
gggcacugggaggcacauuu

SEQ ID NO: 2642 - RNA, 20 nt, Artificial Sequence
  spacer sequence
cagugcccagaaugagaccc

SEQ ID NO: 2643 - RNA, 20 nt, Artificial Sequence
  spacer sequence
uaaaugugccucccagugcc

SEQ ID NO: 2644 - RNA, 20 nt, Artificial Sequence
  spacer sequence
aaauagugucaucaugggag

SEQ ID NO: 2645 - RNA, 20 nt, Artificial Sequence
  spacer sequence
ucaugggagcugcugacgau

SEQ ID NO: 2646 - RNA, 20 nt, Artificial Sequence
  spacer sequence
ugggagcugcugacgauuug

SEQ ID NO: 2647 - RNA, 20 nt, Artificial Sequence
  spacer sequence
caugaugacacuauuuugau

SEQ ID NO: 2648 - RNA, 20 nt, Artificial Sequence
  spacer sequence
gcagcucccaugaugacacu

SEQ ID NO: 2649 - RNA, 20 nt, Artificial Sequence
  spacer sequence
ucagcagcucccaugaugac

SEQ ID NO: 2650 - RNA, 20 nt, Artificial Sequence
  spacer sequence
aaucgucagcagcucccaug

SEQ ID NO: 2651 - RNA, 20 nt, Artificial Sequence
  spacer sequence
ucaaacuguaggcaaaacac

SEQ ID NO: 2652 - RNA, 20 nt, Artificial Sequence
  spacer sequence
aacuguaggcaaaacacaug

SEQ ID NO: 2653 - RNA, 20 nt, Artificial Sequence
  spacer sequence
agaauguuccaccaaugugc

SEQ ID NO: 2654 - RNA, 20 nt, Artificial Sequence
  spacer sequence
ggacauguguuuugccuaca

SEQ ID NO: 2655 - RNA, 20 nt, Artificial Sequence
  spacer sequence
accaaugugcgcaaacacaa

SEQ ID NO: 2656 - RNA, 20 nt, Artificial Sequence
  spacer sequence
agggucaagagcggcuugca

SEQ ID NO: 2657 - RNA, 20 nt, Artificial Sequence
  spacer sequence
agccccagcaagcacauugu

SEQ ID NO: 2658 - RNA, 20 nt, Artificial Sequence
  spacer sequence
agagcggcuugcaaguccua

SEQ ID NO: 2659 - RNA, 20 nt, Artificial Sequence
  spacer sequence
ugacccucgagccccagcaa

SEQ ID NO: 2660 - RNA, 20 nt, Artificial Sequence
  spacer sequence
uaaacuuuaauuuucccauc

SEQ ID NO: 2661 - RNA, 20 nt, Artificial Sequence
  spacer sequence
caucauaggcccggcugacc

SEQ ID NO: 2662 - RNA, 20 nt, Artificial Sequence
  spacer sequence
uaggcccggcugaccauccu

SEQ ID NO: 2663 - RNA, 20 nt, Artificial Sequence
  spacer sequence
gccgggccuaugaugggaaa

SEQ ID NO: 2664 - RNA, 20 nt, Artificial Sequence
  spacer sequence
ucuuguuaucaaacuggaug

SEQ ID NO: 2665 - RNA, 20 nt, Artificial Sequence
  spacer sequence
uguuaucaaacuggaugcau

SEQ ID NO: 2666 - RNA, 20 nt, Artificial Sequence
  spacer sequence
aacuggaugcaucggaccaa

SEQ ID NO: 2667 - RNA, 20 nt, Artificial Sequence
  spacer sequence
aguuugauaacaagaggaug

SEQ ID NO: 2668 - RNA, 20 nt, Artificial Sequence
  spacer sequence
gaccaauucuucaugucccu

SEQ ID NO: 2669 - RNA, 20 nt, Artificial Sequence
  spacer sequence
gaugcauccaguuugauaac

SEQ ID NO: 2670 - RNA, 20 nt, Artificial Sequence
  spacer sequence
ucaugucccucuaggacucu

SEQ ID NO: 2671 - RNA, 20 nt, Artificial Sequence
  spacer sequence
ugucccucuaggacucuuaa

SEQ ID NO: 2672 - RNA, 20 nt, Artificial Sequence
  spacer sequence
cucuaggacucuuaaacagg

SEQ ID NO: 2673 - RNA, 20 nt, Artificial Sequence
  spacer sequence
aggacucuuaaacaggagcc

SEQ ID NO: 2674 - RNA, 20 nt, Artificial Sequence
  spacer sequence
uagagggacaugaagaauug

SEQ ID NO: 2675 - RNA, 20 nt, Artificial Sequence
  spacer sequence
uaaacaggagccacauucaa

SEQ ID NO: 2676 - RNA, 20 nt, Artificial Sequence
  spacer sequence
uguuuaagaguccuagaggg

SEQ ID NO: 2677 - RNA, 20 nt, Artificial Sequence
  spacer sequence
auauccaagagccuaauggu

SEQ ID NO: 2678 - RNA, 20 nt, Artificial Sequence
  spacer sequence
aagagccuaaugguaugauc

SEQ ID NO: 2679 - RNA, 20 nt, Artificial Sequence
  spacer sequence
uggauauugaauguggcucc

SEQ ID NO: 2680 - RNA, 20 nt, Artificial Sequence
  spacer sequence
uaccauuaggcucuuggaua

SEQ ID NO: 2681 - RNA, 20 nt, Artificial Sequence
  spacer sequence
gaugauccacuaacaaccag

SEQ ID NO: 2682 - RNA, 20 nt, Artificial Sequence
  spacer sequence
gaucauaccauuaggcucuu

SEQ ID NO: 2683 - RNA, 20 nt, Artificial Sequence
  spacer sequence
ucagaucauaccauuaggcu

SEQ ID NO: 2684 - RNA, 20 nt, Artificial Sequence
  spacer sequence
acuaacaaccagcccauccc

SEQ ID NO: 2685 - RNA, 20 nt, Artificial Sequence
  spacer sequence
cuguacuggagacaagacuc

SEQ ID NO: 2686 - RNA, 20 nt, Artificial Sequence
  spacer sequence
aguacagggaugggcugguu

SEQ ID NO: 2687 - RNA, 20 nt, Artificial Sequence
  spacer sequence
ccaguacagggaugggcugg

SEQ ID NO: 2688 - RNA, 20 nt, Artificial Sequence
  spacer sequence
ugucuccaguacagggaugg

SEQ ID NO: 2689 - RNA, 20 nt, Artificial Sequence
  spacer sequence
cuugugcccauugagaguac

SEQ ID NO: 2690 - RNA, 20 nt, Artificial Sequence
  spacer sequence
augggcacaagcgagucuug

SEQ ID NO: 2691 - RNA, 20 nt, Artificial Sequence
  spacer sequence
caaugggcacaagcgagucu

SEQ ID NO: 2692 - RNA, 20 nt, Artificial Sequence
  spacer sequence
uacucucaaugggcacaagc

SEQ ID NO: 2693 - RNA, 20 nt, Artificial Sequence
  spacer sequence
caggugcucaugcuccagac

SEQ ID NO: 2694 - RNA, 20 nt, Artificial Sequence
  spacer sequence
ugcuccagacuuugaugguc

SEQ ID NO: 2695 - RNA, 20 nt, Artificial Sequence
  spacer sequence
agacuuugaugguccuguca

SEQ ID NO: 2696 - RNA, 20 nt, Artificial Sequence
  spacer sequence
ggagcaugagcaccugugaa

SEQ ID NO: 2697 - RNA, 20 nt, Artificial Sequence
  spacer sequence
aagucuggagcaugagcacc

SEQ ID NO: 2698 - RNA, 20 nt, Artificial Sequence
  spacer sequence
ugucaccagaggcagacacg

SEQ ID NO: 2699 - RNA, 20 nt, Artificial Sequence
  spacer sequence
ccagaggcagacacgaugua

SEQ ID NO: 2700 - RNA, 20 nt, Artificial Sequence
  spacer sequence
ggugacaggaccaucaaagu

SEQ ID NO: 2701 - RNA, 20 nt, Artificial Sequence
  spacer sequence
gccucuggugacaggaccau

SEQ ID NO: 2702 - RNA, 20 nt, Artificial Sequence
  spacer sequence
ugucugccucuggugacagg

SEQ ID NO: 2703 - RNA, 20 nt, Artificial Sequence
  spacer sequence
cgucaaagucuacuacguug

SEQ ID NO: 2704 - RNA, 20 nt, Artificial Sequence
  spacer sequence
ucaaagucuacuacguugac

SEQ ID NO: 2705 - RNA, 20 nt, Artificial Sequence
  spacer sequence
aagucuacuacguugacagc

SEQ ID NO: 2706 - RNA, 20 nt, Artificial Sequence
  spacer sequence
acuacguugacagcagcuca

SEQ ID NO: 2707 - RNA, 20 nt, Artificial Sequence
  spacer sequence
acguaguagacuuugacgag

SEQ ID NO: 2708 - RNA, 20 nt, Artificial Sequence
  spacer sequence
guggacaaccaggacaccac

SEQ ID NO: 2709 - RNA, 20 nt, Artificial Sequence
  spacer sequence
acugagcugcugucaacgua

SEQ ID NO: 2710 - RNA, 20 nt, Artificial Sequence
  spacer sequence
ugguuguccacugagcugcu

SEQ ID NO: 2711 - RNA, 20 nt, Artificial Sequence
  spacer sequence
cuuuacgugguguccugguu

SEQ ID NO: 2712 - RNA, 20 nt, Artificial Sequence
  spacer sequence
gucgcagaagccauguccca

SEQ ID NO: 2713 - RNA, 20 nt, Artificial Sequence
  spacer sequence
cagaagccaugucccacaca

SEQ ID NO: 2714 - RNA, 20 nt, Artificial Sequence
  spacer sequence
gcgaccgauaucacuuuacg

SEQ ID NO: 2715 - RNA, 20 nt, Artificial Sequence
  spacer sequence
cacacagcaauggagcgguc

SEQ ID NO: 2716 - RNA, 20 nt, Artificial Sequence
  spacer sequence
auugcugugugggacauggc

SEQ ID NO: 2717 - RNA, 20 nt, Artificial Sequence
  spacer sequence
uuggaacaggucaccaucag

SEQ ID NO: 2718 - RNA, 20 nt, Artificial Sequence
  spacer sequence
aaggaccgcuccauugcugu

SEQ ID NO: 2719 - RNA, 20 nt, Artificial Sequence
  spacer sequence
ccaucaguccacugcugaag

SEQ ID NO: 2720 - RNA, 20 nt, Artificial Sequence
  spacer sequence
guccacugcugaagcguaag

SEQ ID NO: 2721 - RNA, 20 nt, Artificial Sequence
  spacer sequence
acugcugaagcguaagugca

SEQ ID NO: 2722 - RNA, 20 nt, Artificial Sequence
  spacer sequence
gcaguggacugauggugacc

SEQ ID NO: 2723 - RNA, 20 nt, Artificial Sequence
  spacer sequence
ucauugugguggauuaaugu

SEQ ID NO: 2724 - RNA, 20 nt, Artificial Sequence
  spacer sequence
uugugguggauuaauguguu

SEQ ID NO: 2725 - RNA, 20 nt, Artificial Sequence
  spacer sequence
accacaaugaggauguacug

SEQ ID NO: 2726 - RNA, 20 nt, Artificial Sequence
  spacer sequence
uaacacauuaauccaccaca

SEQ ID NO: 2727 - RNA, 20 nt, Artificial Sequence
  spacer sequence
cccguguucacuucccacac

SEQ ID NO: 2728 - RNA, 20 nt, Artificial Sequence
  spacer sequence
cuucccacacucucaccgua

SEQ ID NO: 2729 - RNA, 20 nt, Artificial Sequence
  spacer sequence
cacacucucaccguagaauc

SEQ ID NO: 2730 - RNA, 20 nt, Artificial Sequence
  spacer sequence
caccguagaauccgaagagc

SEQ ID NO: 2731 - RNA, 20 nt, Artificial Sequence
  spacer sequence
ccguagaauccgaagagcca

SEQ ID NO: 2732 - RNA, 20 nt, Artificial Sequence
  spacer sequence
acggugagagugugggaagu

SEQ ID NO: 2733 - RNA, 20 nt, Artificial Sequence
  spacer sequence
gaagagccaguuacaaugac

SEQ ID NO: 2734 - RNA, 20 nt, Artificial Sequence
  spacer sequence
gauucuacggugagagugug

SEQ ID NO: 2735 - RNA, 20 nt, Artificial Sequence
  spacer sequence
ucggauucuacggugagagu

SEQ ID NO: 2736 - RNA, 20 nt, Artificial Sequence
  spacer sequence
uuguaacuggcucuucggau

SEQ ID NO: 2737 - RNA, 20 nt, Artificial Sequence
  spacer sequence
uccuacugcagauagaggac

SEQ ID NO: 2738 - RNA, 20 nt, Artificial Sequence
  spacer sequence
uacugcagauagaggacaga

SEQ ID NO: 2739 - RNA, 20 nt, Artificial Sequence
  spacer sequence
gcaguaggaugagcguguca

SEQ ID NO: 2740 - RNA, 20 nt, Artificial Sequence
  spacer sequence
aucugcaguaggaugagcgu

SEQ ID NO: 2741 - RNA, 20 nt, Artificial Sequence
  spacer sequence
ucuaucugcaguaggaugag

SEQ ID NO: 2742 - RNA, 20 nt, Artificial Sequence
  spacer sequence
guccucuaucugcaguagga

SEQ ID NO: 2743 - RNA, 20 nt, Artificial Sequence
  spacer sequence
aacauuccaggcugguuuua

SEQ ID NO: 2744 - RNA, 20 nt, Artificial Sequence
  spacer sequence
aggcugguuuuaucccaaau

SEQ ID NO: 2745 - RNA, 20 nt, Artificial Sequence
  spacer sequence
caaaucuuaauuaucuugua

SEQ ID NO: 2746 - RNA, 20 nt, Artificial Sequence
  spacer sequence
uaauuaucuuguaggccacu

SEQ ID NO: 2747 - RNA, 20 nt, Artificial Sequence
  spacer sequence
uguaggccacugauaauuuu

SEQ ID NO: 2748 - RNA, 20 nt, Artificial Sequence
  spacer sequence
guggccuacaagauaauuaa

SEQ ID NO: 2749 - RNA, 20 nt, Artificial Sequence
  spacer sequence
ucaucguacuguaaaccaua

SEQ ID NO: 2750 - RNA, 20 nt, Artificial Sequence
  spacer sequence
ucguacuguaaaccauagac

SEQ ID NO: 2751 - RNA, 20 nt, Artificial Sequence
  spacer sequence
uacuguaaaccauagacacc

SEQ ID NO: 2752 - RNA, 20 nt, Artificial Sequence
  spacer sequence
augguuuacaguacgaugau

SEQ ID NO: 2753 - RNA, 20 nt, Artificial Sequence
  spacer sequence
gagugguacugaauccucug

SEQ ID NO: 2754 - RNA, 20 nt, Artificial Sequence
  spacer sequence
gaaaauaguaaaggugucua

SEQ ID NO: 2755 - RNA, 20 nt, Artificial Sequence
  spacer sequence
guaccacucugaaaauagua

SEQ ID NO: 2756 - RNA, 20 nt, Artificial Sequence
  spacer sequence
ucugcaagcugugucggcca

SEQ ID NO: 2757 - RNA, 20 nt, Artificial Sequence
  spacer sequence
gcaagcugugucggccacac

SEQ ID NO: 2758 - RNA, 20 nt, Artificial Sequence
  spacer sequence
gccacaccgcuagguggauu

SEQ ID NO: 2759 - RNA, 20 nt, Artificial Sequence
  spacer sequence
accuagcgguguggccgaca

SEQ ID NO: 2760 - RNA, 20 nt, Artificial Sequence
  spacer sequence
auagucucuauauccuggau

SEQ ID NO: 2761 - RNA, 20 nt, Artificial Sequence
  spacer sequence
cuauauccuggauaauguuu

SEQ ID NO: 2762 - RNA, 20 nt, Artificial Sequence
  spacer sequence
auauccuggauaauguuugg

SEQ ID NO: 2763 - RNA, 20 nt, Artificial Sequence
  spacer sequence
uggauaauguuuggguauaa

SEQ ID NO: 2764 - RNA, 20 nt, Artificial Sequence
  spacer sequence
aggauauagagacuauagaa

SEQ ID NO: 2765 - RNA, 20 nt, Artificial Sequence
  spacer sequence
uuauacccaaacauuaucca

SEQ ID NO: 2766 - RNA, 20 nt, Artificial Sequence
  spacer sequence
uuuuauaggucauuauaccc

SEQ ID NO: 2767 - RNA, 20 nt, Artificial Sequence
  spacer sequence
aaauucauuuuauaggucau

SEQ ID NO: 2768 - RNA, 20 nt, Artificial Sequence
  spacer sequence
agcccuccaaauucauuuua

SEQ ID NO: 2769 - RNA, 20 nt, Artificial Sequence
  spacer sequence
guuuugaaacagguacugau

SEQ ID NO: 2770 - RNA, 20 nt, Artificial Sequence
  spacer sequence
aaacagacccauaucuagcc

SEQ ID NO: 2771 - RNA, 20 nt, Artificial Sequence
  spacer sequence
guaccuguuucaaaacagac

SEQ ID NO: 2772 - RNA, 20 nt, Artificial Sequence
  spacer sequence
cacccucuucuuucugaaag

SEQ ID NO: 2773 - RNA, 20 nt, Artificial Sequence
  spacer sequence
ucuuucugaaaguccuuucc

SEQ ID NO: 2774 - RNA, 20 nt, Artificial Sequence
  spacer sequence
uucugaaaguccuuuccaua

SEQ ID NO: 2775 - RNA, 20 nt, Artificial Sequence
  spacer sequence
gaaaguccuuuccauagggg

SEQ ID NO: 2776 - RNA, 20 nt, Artificial Sequence
  spacer sequence
gaaagaagagggugggauca

SEQ ID NO: 2777 - RNA, 20 nt, Artificial Sequence
  spacer sequence
uuuccauaggggaucagugu

SEQ ID NO: 2778 - RNA, 20 nt, Artificial Sequence
  spacer sequence
auaggggaucaguguguacc

SEQ ID NO: 2779 - RNA, 20 nt, Artificial Sequence
  spacer sequence
ccuauggaaaggacuuucag

SEQ ID NO: 2780 - RNA, 20 nt, Artificial Sequence
  spacer sequence
guguguaccauucguucaau

SEQ ID NO: 2781 - RNA, 20 nt, Artificial Sequence
  spacer sequence
uucaaucagcuucuuccaaa

SEQ ID NO: 2782 - RNA, 20 nt, Artificial Sequence
  spacer sequence
aucagcuucuuccaaagcau

SEQ ID NO: 2783 - RNA, 20 nt, Artificial Sequence
  spacer sequence
gcuucuuccaaagcauucau

SEQ ID NO: 2784 - RNA, 20 nt, Artificial Sequence
  spacer sequence
uccaaagcauucauucugag

SEQ ID NO: 2785 - RNA, 20 nt, Artificial Sequence
  spacer sequence
aaagcauucauucugagauc

SEQ ID NO: 2786 - RNA, 20 nt, Artificial Sequence
  spacer sequence
uucugagaucaaucccugcc

SEQ ID NO: 2787 - RNA, 20 nt, Artificial Sequence
  spacer sequence
gagaucaaucccugccaucc

SEQ ID NO: 2788 - RNA, 20 nt, Artificial Sequence
  spacer sequence
gaaugaaugcuuuggaagaa

SEQ ID NO: 2789 - RNA, 20 nt, Artificial Sequence
  spacer sequence
cagaaugaaugcuuuggaag

SEQ ID NO: 2790 - RNA, 20 nt, Artificial Sequence
  spacer sequence
aucccugccauccuuuacau

SEQ ID NO: 2791 - RNA, 20 nt, Artificial Sequence
  spacer sequence
cugccauccuuuacauacca

SEQ ID NO: 2792 - RNA, 20 nt, Artificial Sequence
  spacer sequence
uuuacauaccagcucugcug

SEQ ID NO: 2793 - RNA, 20 nt, Artificial Sequence
  spacer sequence
gcugcacacagagaccuggu

SEQ ID NO: 2794 - RNA, 20 nt, Artificial Sequence
  spacer sequence
gugugcagcagagcugguau

SEQ ID NO: 2795 - RNA, 20 nt, Artificial Sequence
  spacer sequence
cugugugcagcagagcuggu

SEQ ID NO: 2796 - RNA, 20 nt, Artificial Sequence
  spacer sequence
uuuguaccugguuaccaggu

SEQ ID NO: 2797 - RNA, 20 nt, Artificial Sequence
  spacer sequence
gcuaugugaucuaagccuug

SEQ ID NO: 2798 - RNA, 20 nt, Artificial Sequence
  spacer sequence
cauagcagaaaacauucuuu

SEQ ID NO: 2799 - RNA, 20 nt, Artificial Sequence
  spacer sequence
aagccuugcucggguaaagc

SEQ ID NO: 2800 - RNA, 20 nt, Artificial Sequence
  spacer sequence
gguaaagcaguaauaaaguc

SEQ ID NO: 2801 - RNA, 20 nt, Artificial Sequence
  spacer sequence
ugcugcaacaugggcuucag

SEQ ID NO: 2802 - RNA, 20 nt, Artificial Sequence
  spacer sequence
gguaagaguugauacgucca

SEQ ID NO: 2803 - RNA, 20 nt, Artificial Sequence
  spacer sequence
uaccugaagcccauguugca

SEQ ID NO: 2804 - RNA, 20 nt, Artificial Sequence
  spacer sequence
acucuuaccugaagcccaug

SEQ ID NO: 2805 - RNA, 20 nt, Artificial Sequence
  spacer sequence
auggugauaaugacacauuc

SEQ ID NO: 2806 - RNA, 20 nt, Artificial Sequence
  spacer sequence
ccauggacguaucaacucuu

SEQ ID NO: 2807 - RNA, 20 nt, Artificial Sequence
  spacer sequence
uuaucaccauggacguauca

SEQ ID NO: 2808 - RNA, 20 nt, Artificial Sequence
  spacer sequence
ugaaauaagauguuccacaa

SEQ ID NO: 2809 - RNA, 20 nt, Artificial Sequence
  spacer sequence
cgaaugugucauuaucacca

SEQ ID NO: 2810 - RNA, 20 nt, Artificial Sequence
  spacer sequence
uauuucacgaaugugucauu

SEQ ID NO: 2811 - RNA, 20 nt, Artificial Sequence
  spacer sequence
acaaauuccaacugaucuga

SEQ ID NO: 2812 - RNA, 20 nt, Artificial Sequence
  spacer sequence
aacugaucugauucagaccc

SEQ ID NO: 2813 - RNA, 20 nt, Artificial Sequence
  spacer sequence
guuggaauuuguggaacauc

SEQ ID NO: 2814 - RNA, 20 nt, Artificial Sequence
  spacer sequence
gauucagaccccugguuaaa

SEQ ID NO: 2815 - RNA, 20 nt, Artificial Sequence
  spacer sequence
gaucaguuggaauuugugga

SEQ ID NO: 2816 - RNA, 20 nt, Artificial Sequence
  spacer sequence
gaccccugguuaaaauauug

SEQ ID NO: 2817 - RNA, 20 nt, Artificial Sequence
  spacer sequence
gaaucagaucaguuggaauu

SEQ ID NO: 2818 - RNA, 20 nt, Artificial Sequence
  spacer sequence
auauuuuaaccaggggucug

SEQ ID NO: 2819 - RNA, 20 nt, Artificial Sequence
  spacer sequence
uuuucuuuuugguaguuucc

SEQ ID NO: 2820 - RNA, 20 nt, Artificial Sequence
  spacer sequence
uuuugguaguuuccuucuga

SEQ ID NO: 2821 - RNA, 20 nt, Artificial Sequence
  spacer sequence
uucugauggccucuuucugg

SEQ ID NO: 2822 - RNA, 20 nt, Artificial Sequence
  spacer sequence
gauggccucuuucuggagau

SEQ ID NO: 2823 - RNA, 20 nt, Artificial Sequence
  spacer sequence
gaaggaaacuaccaaaaaga

SEQ ID NO: 2824 - RNA, 20 nt, Artificial Sequence
  spacer sequence
uucuggagaugaucacaaau

SEQ ID NO: 2825 - RNA, 20 nt, Artificial Sequence
  spacer sequence
ggagaugaucacaaaugaug

SEQ ID NO: 2826 - RNA, 20 nt, Artificial Sequence
  spacer sequence
agaaagaggccaucagaagg

SEQ ID NO: 2827 - RNA, 20 nt, Artificial Sequence
  spacer sequence
ccagaaagaggccaucagaa

SEQ ID NO: 2828 - RNA, 20 nt, Artificial Sequence
  spacer sequence
ucuccagaaagaggccauca

SEQ ID NO: 2829 - RNA, 20 nt, Artificial Sequence
  spacer sequence
caaaugauguuccauuacuu

SEQ ID NO: 2830 - RNA, 20 nt, Artificial Sequence
  spacer sequence
uuugugaucaucuccagaaa

SEQ ID NO: 2831 - RNA, 20 nt, Artificial Sequence
  spacer sequence
auuacuuaucugccaaggag

SEQ ID NO: 2832 - RNA, 20 nt, Artificial Sequence
  spacer sequence
gccaaggaguauuuuucuuu

SEQ ID NO: 2833 - RNA, 20 nt, Artificial Sequence
  spacer sequence
uuggcagauaaguaauggaa

SEQ ID NO: 2834 - RNA, 20 nt, Artificial Sequence
  spacer sequence
uuggggacuuaucuucaucu

SEQ ID NO: 2835 - RNA, 20 nt, Artificial Sequence
  spacer sequence
ccaaagaaaaauacuccuug

SEQ ID NO: 2836 - RNA, 20 nt, Artificial Sequence
  spacer sequence
ucaucuugaucuuccagaac

SEQ ID NO: 2837 - RNA, 20 nt, Artificial Sequence
  spacer sequence
ucuugaucuuccagaacuga

SEQ ID NO: 2838 - RNA, 20 nt, Artificial Sequence
  spacer sequence
ugaucuuccagaacugaagu

SEQ ID NO: 2839 - RNA, 20 nt, Artificial Sequence
  spacer sequence
agaugaagauaaguccccaa

SEQ ID NO: 2840 - RNA, 20 nt, Artificial Sequence
  spacer sequence
uccagaacugaaguguuagu

SEQ ID NO: 2841 - RNA, 20 nt, Artificial Sequence
  spacer sequence
agaacugaaguguuaguucc

SEQ ID NO: 2842 - RNA, 20 nt, Artificial Sequence
  spacer sequence
ggaagaucaagaugaagaua

SEQ ID NO: 2843 - RNA, 20 nt, Artificial Sequence
  spacer sequence
guucuggaagaucaagauga

SEQ ID NO: 2844 - RNA, 20 nt, Artificial Sequence
  spacer sequence
acauggcuggggaggccuca

SEQ ID NO: 2845 - RNA, 20 nt, Artificial Sequence
  spacer sequence
ccagccauguggaacuaaca

SEQ ID NO: 2846 - RNA, 20 nt, Artificial Sequence
  spacer sequence
uaaucacggcagaaggcaag

SEQ ID NO: 2847 - RNA, 20 nt, Artificial Sequence
  spacer sequence
cggcagaaggcaaggaggag

SEQ ID NO: 2848 - RNA, 20 nt, Artificial Sequence
  spacer sequence
gccgugauuaugaggccucc

SEQ ID NO: 2849 - RNA, 20 nt, Artificial Sequence
  spacer sequence
uugccuucugccgugauuau

SEQ ID NO: 2850 - RNA, 20 nt, Artificial Sequence
  spacer sequence
uccuugccuucugccgugau

SEQ ID NO: 2851 - RNA, 20 nt, Artificial Sequence
  spacer sequence
caucuuacgugcaauggcag

SEQ ID NO: 2852 - RNA, 20 nt, Artificial Sequence
  spacer sequence
uacgugcaauggcagcaagc

SEQ ID NO: 2853 - RNA, 20 nt, Artificial Sequence
  spacer sequence
uugcuugcugccauugcacg

SEQ ID NO: 2854 - RNA, 20 nt, Artificial Sequence
  spacer sequence
cuuugcuugcugccauugca

SEQ ID NO: 2855 - RNA, 20 nt, Artificial Sequence
  spacer sequence
cucuuugcuugcugccauug

SEQ ID NO: 2856 - RNA, 20 nt, Artificial Sequence
  spacer sequence
cucucuuugcuugcugccau

SEQ ID NO: 2857 - RNA, 20 nt, Artificial Sequence
  spacer sequence
cugcacaagcuucucucucu

SEQ ID NO: 2858 - RNA, 20 nt, Artificial Sequence
  spacer sequence
ccuuuuuuaaaaacauccga

SEQ ID NO: 2859 - RNA, 20 nt, Artificial Sequence
  spacer sequence
gaucucaaccaggugcggug

SEQ ID NO: 2860 - RNA, 20 nt, Artificial Sequence
  spacer sequence
gauguuuuuaaaaaagggga

SEQ ID NO: 2861 - RNA, 20 nt, Artificial Sequence
  spacer sequence
caaccaggugcgguggcuca

SEQ ID NO: 2862 - RNA, 20 nt, Artificial Sequence
  spacer sequence
accaggugcgguggcucaug

SEQ ID NO: 2863 - RNA, 20 nt, Artificial Sequence
  spacer sequence
ugccuguaaucccagcacuu

SEQ ID NO: 2864 - RNA, 20 nt, Artificial Sequence
  spacer sequence
cagcacuuugggaggccgag

SEQ ID NO: 2865 - RNA, 20 nt, Artificial Sequence
  spacer sequence
caaagugcugggauuacagg

SEQ ID NO: 2866 - RNA, 20 nt, Artificial Sequence
  spacer sequence
gccucccaaagugcugggau

SEQ ID NO: 2867 - RNA, 20 nt, Artificial Sequence
  spacer sequence
acccaccucggccucccaaa

SEQ ID NO: 2868 - RNA, 20 nt, Artificial Sequence
  spacer sequence
ccugaggucaggaguuugag

SEQ ID NO: 2869 - RNA, 20 nt, Artificial Sequence
  spacer sequence
ggugauccacccaccucggc

SEQ ID NO: 2870 - RNA, 20 nt, Artificial Sequence
  spacer sequence
ggaguuugagaccagccuga

SEQ ID NO: 2871 - RNA, 20 nt, Artificial Sequence
  spacer sequence
ugaccucaggugauccaccc

SEQ ID NO: 2872 - RNA, 20 nt, Artificial Sequence
  spacer sequence
aacuccugaccucaggugau

SEQ ID NO: 2873 - RNA, 20 nt, Artificial Sequence
  spacer sequence
caaacuccugaccucaggug

SEQ ID NO: 2874 - RNA, 20 nt, Artificial Sequence
  spacer sequence
ggcuggucucaaacuccuga

SEQ ID NO: 2875 - RNA, 20 nt, Artificial Sequence
  spacer sequence
auuggucaggcuggucucaa

SEQ ID NO: 2876 - RNA, 20 nt, Artificial Sequence
  spacer sequence
ccauuggucaggcuggucuc

SEQ ID NO: 2877 - RNA, 20 nt, Artificial Sequence
  spacer sequence
cuacuaaaaauacaaaauua

SEQ ID NO: 2878 - RNA, 20 nt, Artificial Sequence
  spacer sequence
acuaaaaauacaaaauuagc

SEQ ID NO: 2879 - RNA, 20 nt, Artificial Sequence
  spacer sequence
cagcaacuugggaggcugag

SEQ ID NO: 2880 - RNA, 20 nt, Artificial Sequence
  spacer sequence
caaguugcugggauuacagg

SEQ ID NO: 2881 - RNA, 20 nt, Artificial Sequence
  spacer sequence
gccucccaaguugcugggau

SEQ ID NO: 2882 - RNA, 20 nt, Artificial Sequence
  spacer sequence
ugccucagccucccaaguug

SEQ ID NO: 2883 - RNA, 20 nt, Artificial Sequence
  spacer sequence
ccugccucagccucccaagu

SEQ ID NO: 2884 - RNA, 20 nt, Artificial Sequence
  spacer sequence
cuugaacuugggagauagag

SEQ ID NO: 2885 - RNA, 20 nt, Artificial Sequence
  spacer sequence
agcgauucuccugccucagc

SEQ ID NO: 2886 - RNA, 20 nt, Artificial Sequence
  spacer sequence
caaguucaagcgauucuccu

SEQ ID NO: 2887 - RNA, 20 nt, Artificial Sequence
  spacer sequence
cccaaguucaagcgauucuc

SEQ ID NO: 2888 - RNA, 20 nt, Artificial Sequence
  spacer sequence
aucucccaaguucaagcgau

SEQ ID NO: 2889 - RNA, 20 nt, Artificial Sequence
  spacer sequence
cugcaaccucuaucucccaa

SEQ ID NO: 2890 - RNA, 20 nt, Artificial Sequence
  spacer sequence
uggcucacugcaaccucuau

SEQ ID NO: 2891 - RNA, 20 nt, Artificial Sequence
  spacer sequence
agccugggugacagagugag

SEQ ID NO: 2892 - RNA, 20 nt, Artificial Sequence
  spacer sequence
cccaggcuggagugcagugg

SEQ ID NO: 2893 - RNA, 20 nt, Artificial Sequence
  spacer sequence
gucacccaggcuggagugca

SEQ ID NO: 2894 - RNA, 20 nt, Artificial Sequence
  spacer sequence
cucugucacccaggcuggag

SEQ ID NO: 2895 - RNA, 20 nt, Artificial Sequence
  spacer sequence
cacucugucacccaggcugg

SEQ ID NO: 2896 - RNA, 20 nt, Artificial Sequence
  spacer sequence
aucucaaaaaaaaaaaaaaa

SEQ ID NO: 2897 - RNA, 20 nt, Artificial Sequence
  spacer sequence
caaaaaaaaaaaaaaaaauu

SEQ ID NO: 2898 - RNA, 20 nt, Artificial Sequence
  spacer sequence
aaaaaaaaaaaaaaaauuac

SEQ ID NO: 2899 - RNA, 20 nt, Artificial Sequence
  spacer sequence
caauuaagaaaaacaauuaa

SEQ ID NO: 2900 - RNA, 20 nt, Artificial Sequence
  spacer sequence
uaauugugaauauguauuac

SEQ ID NO: 2901 - RNA, 20 nt, Artificial Sequence
  spacer sequence
auuuaauuguuuuucuuaau

SEQ ID NO: 2902 - RNA, 20 nt, Artificial Sequence
  spacer sequence
uuuuucuauuuaauuguuuu

SEQ ID NO: 2903 - RNA, 20 nt, Artificial Sequence
  spacer sequence
uuuuugcucuuuuuucuauu

SEQ ID NO: 2904 - RNA, 20 nt, Artificial Sequence
  spacer sequence
cagcuacuugggaggcugag

SEQ ID NO: 2905 - RNA, 20 nt, Artificial Sequence
  spacer sequence
caaguagcugggauuacagg

SEQ ID NO: 2906 - RNA, 20 nt, Artificial Sequence
  spacer sequence
gccucccaaguagcugggau

SEQ ID NO: 2907 - RNA, 20 nt, Artificial Sequence
  spacer sequence
accucagccucccaaguagc

SEQ ID NO: 2908 - RNA, 20 nt, Artificial Sequence
  spacer sequence
agcaauuuuucuaccucagc

SEQ ID NO: 2909 - RNA, 20 nt, Artificial Sequence
  spacer sequence
uggguucaagcaauuuuucu

SEQ ID NO: 2910 - RNA, 20 nt, Artificial Sequence
  spacer sequence
accuccuggguucaagcaau

SEQ ID NO: 2911 - RNA, 20 nt, Artificial Sequence
  spacer sequence
cugcaaccuccaccuccugg

SEQ ID NO: 2912 - RNA, 20 nt, Artificial Sequence
  spacer sequence
gcucacugcaaccuccaccu

SEQ ID NO: 2913 - RNA, 20 nt, Artificial Sequence
  spacer sequence
cagcucacugcaaccuccac

SEQ ID NO: 2914 - RNA, 20 nt, Artificial Sequence
  spacer sequence
agccugggcaacaagagcga

SEQ ID NO: 2915 - RNA, 20 nt, Artificial Sequence
  spacer sequence
uguugcccaggcuggagugc

SEQ ID NO: 2916 - RNA, 20 nt, Artificial Sequence
  spacer sequence
cucuuguugcccaggcugga

SEQ ID NO: 2917 - RNA, 20 nt, Artificial Sequence
  spacer sequence
ucucaaaagaagaagaagaa

SEQ ID NO: 2918 - RNA, 20 nt, Artificial Sequence
  spacer sequence
caaaagaagaagaagaagac

SEQ ID NO: 2919 - RNA, 20 nt, Artificial Sequence
  spacer sequence
aaagaagaagaagaagacaa

SEQ ID NO: 2920 - RNA, 20 nt, Artificial Sequence
  spacer sequence
uuugagaugaaguuucgcuc

SEQ ID NO: 2921 - RNA, 20 nt, Artificial Sequence
  spacer sequence
ucuuuugagaugaaguuucg

SEQ ID NO: 2922 - RNA, 20 nt, Artificial Sequence
  spacer sequence
ucuucuuuugagaugaaguu

SEQ ID NO: 2923 - RNA, 20 nt, Artificial Sequence
  spacer sequence
ucuucuucuuuugagaugaa

SEQ ID NO: 2924 - RNA, 20 nt, Artificial Sequence
  spacer sequence
ucuucuucuucuuuugagau

SEQ ID NO: 2925 - RNA, 20 nt, Artificial Sequence
  spacer sequence
uugucuucuucuucuucuuu

SEQ ID NO: 2926 - RNA, 20 nt, Artificial Sequence
  spacer sequence
guucuuugucuucuucuucu

SEQ ID NO: 2927 - RNA, 20 nt, Artificial Sequence
  spacer sequence
cuguucuuugucuucuucuu

SEQ ID NO: 2928 - RNA, 20 nt, Artificial Sequence
  spacer sequence
uucuccuucccauaacuccc

SEQ ID NO: 2929 - RNA, 20 nt, Artificial Sequence
  spacer sequence
ccuucccauaacucccccuc

SEQ ID NO: 2930 - RNA, 20 nt, Artificial Sequence
  spacer sequence
uucccauaacucccccucgc

SEQ ID NO: 2931 - RNA, 20 nt, Artificial Sequence
  spacer sequence
cauaacucccccucgcaggc

SEQ ID NO: 2932 - RNA, 20 nt, Artificial Sequence
  spacer sequence
cccucgcaggccugccuucc

SEQ ID NO: 2933 - RNA, 20 nt, Artificial Sequence
  spacer sequence
caggccugccuuccgcuagc

SEQ ID NO: 2934 - RNA, 20 nt, Artificial Sequence
  spacer sequence
gcuagccaucuccuggacuu

SEQ ID NO: 2935 - RNA, 20 nt, Artificial Sequence
  spacer sequence
ccuggacuuccucaggcuug

SEQ ID NO: 2936 - RNA, 20 nt, Artificial Sequence
  spacer sequence
uggacuuccucaggcuugac

SEQ ID NO: 2937 - RNA, 20 nt, Artificial Sequence
  spacer sequence
aggagauggcuagcggaagg

SEQ ID NO: 2938 - RNA, 20 nt, Artificial Sequence
  spacer sequence
ucaggcuugacccuggcauc

SEQ ID NO: 2939 - RNA, 20 nt, Artificial Sequence
  spacer sequence
ggcuugacccuggcauccag

SEQ ID NO: 2940 - RNA, 20 nt, Artificial Sequence
  spacer sequence
agccugaggaaguccaggag

SEQ ID NO: 2941 - RNA, 20 nt, Artificial Sequence
  spacer sequence
aggguuucucccuuacuggc

SEQ ID NO: 2942 - RNA, 20 nt, Artificial Sequence
  spacer sequence
cccuuacuggcaggcaacac

SEQ ID NO: 2943 - RNA, 20 nt, Artificial Sequence
  spacer sequence
cuuacuggcaggcaacaccc

SEQ ID NO: 2944 - RNA, 20 nt, Artificial Sequence
  spacer sequence
aggugggcuucuuuggaagc

SEQ ID NO: 2945 - RNA, 20 nt, Artificial Sequence
  spacer sequence
uuggaagcagaguuacuugc

SEQ ID NO: 2946 - RNA, 20 nt, Artificial Sequence
  spacer sequence
aaagaagcccaccuggaaug

SEQ ID NO: 2947 - RNA, 20 nt, Artificial Sequence
  spacer sequence
gcuuccaaagaagcccaccu

SEQ ID NO: 2948 - RNA, 20 nt, Artificial Sequence
  spacer sequence
aggcaaguaacucugcuucc

SEQ ID NO: 2949 - RNA, 20 nt, Artificial Sequence
  spacer sequence
aacucaaggcaaguaacucu

SEQ ID NO: 2950 - RNA, 20 nt, Artificial Sequence
  spacer sequence
accccaccccuccaacucaa

SEQ ID NO: 2951 - RNA, 20 nt, Artificial Sequence
  spacer sequence
ucccuuccccacaagcuaac

SEQ ID NO: 2952 - RNA, 20 nt, Artificial Sequence
  spacer sequence
cuuccccacaagcuaaccac

SEQ ID NO: 2953 - RNA, 20 nt, Artificial Sequence
  spacer sequence
ccacaagcuaaccacacucu

SEQ ID NO: 2954 - RNA, 20 nt, Artificial Sequence
  spacer sequence
ucacagaaaggauugcucug

SEQ ID NO: 2955 - RNA, 20 nt, Artificial Sequence
  spacer sequence
cagaaaggauugcucugaug

SEQ ID NO: 2956 - RNA, 20 nt, Artificial Sequence
  spacer sequence
gugaagagugugguuagcuu

SEQ ID NO: 2957 - RNA, 20 nt, Artificial Sequence
  spacer sequence
uuucugugaagagugugguu

SEQ ID NO: 2958 - RNA, 20 nt, Artificial Sequence
  spacer sequence
gaugugccuauggauccucc

SEQ ID NO: 2959 - RNA, 20 nt, Artificial Sequence
  spacer sequence
gagcaauccuuucugugaag

SEQ ID NO: 2960 - RNA, 20 nt, Artificial Sequence
  spacer sequence
auaggcacaucagagcaauc

SEQ ID NO: 2961 - RNA, 20 nt, Artificial Sequence
  spacer sequence
ucccuuuccccuugacagcc

SEQ ID NO: 2962 - RNA, 20 nt, Artificial Sequence
  spacer sequence
cuuuccccuugacagccugc

SEQ ID NO: 2963 - RNA, 20 nt, Artificial Sequence
  spacer sequence
ccuugacagccugcaggaaa

SEQ ID NO: 2964 - RNA, 20 nt, Artificial Sequence
  spacer sequence
aggggaaagggaggauccau

SEQ ID NO: 2965 - RNA, 20 nt, Artificial Sequence
  spacer sequence
ugcaggcugucaaggggaaa

SEQ ID NO: 2966 - RNA, 20 nt, Artificial Sequence
  spacer sequence
uuuccugcaggcugucaagg

SEQ ID NO: 2967 - RNA, 20 nt, Artificial Sequence
  spacer sequence
aggucagagaauugguccug

SEQ ID NO: 2968 - RNA, 20 nt, Artificial Sequence
  spacer sequence
gagaauugguccugccaccu

SEQ ID NO: 2969 - RNA, 20 nt, Artificial Sequence
  spacer sequence
gaccuggaacccauuccuuu

SEQ ID NO: 2970 - RNA, 20 nt, Artificial Sequence
  spacer sequence
cugaccuggaacccauuccu

SEQ ID NO: 2971 - RNA, 20 nt, Artificial Sequence
  spacer sequence
ugccaccucuuagcaaguua

SEQ ID NO: 2972 - RNA, 20 nt, Artificial Sequence
  spacer sequence
uagcaaguuaugugggguug

SEQ ID NO: 2973 - RNA, 20 nt, Artificial Sequence
  spacer sequence
ucacuuugaaaugucagcgg

SEQ ID NO: 2974 - RNA, 20 nt, Artificial Sequence
  spacer sequence
cuuugaaaugucagcggcuu

SEQ ID NO: 2975 - RNA, 20 nt, Artificial Sequence
  spacer sequence
aagugaggaguaaaggcaac

SEQ ID NO: 2976 - RNA, 20 nt, Artificial Sequence
  spacer sequence
gcggcuugucacuugucacu

SEQ ID NO: 2977 - RNA, 20 nt, Artificial Sequence
  spacer sequence
cuugucacuuauauucucgg

SEQ ID NO: 2978 - RNA, 20 nt, Artificial Sequence
  spacer sequence
cuuauauucucgguuugagg

SEQ ID NO: 2979 - RNA, 20 nt, Artificial Sequence
  spacer sequence
cgguuugaggcuucagcuga

SEQ ID NO: 2980 - RNA, 20 nt, Artificial Sequence
  spacer sequence
guuugaggcuucagcugaca

SEQ ID NO: 2981 - RNA, 20 nt, Artificial Sequence
  spacer sequence
aaccgagaauauaagugaca

SEQ ID NO: 2982 - RNA, 20 nt, Artificial Sequence
  spacer sequence
gcugacauccucagacaaga

SEQ ID NO: 2983 - RNA, 20 nt, Artificial Sequence
  spacer sequence
gcugaagccucaaaccgaga

SEQ ID NO: 2984 - RNA, 20 nt, Artificial Sequence
  spacer sequence
ucagacaagagucuguuaug

SEQ ID NO: 2985 - RNA, 20 nt, Artificial Sequence
  spacer sequence
gacaagagucuguuaugguc

SEQ ID NO: 2986 - RNA, 20 nt, Artificial Sequence
  spacer sequence
gaggaugucagcugaagccu

SEQ ID NO: 2987 - RNA, 20 nt, Artificial Sequence
  spacer sequence
ugucugaggaugucagcuga

SEQ ID NO: 2988 - RNA, 20 nt, Artificial Sequence
  spacer sequence
guuauggucuuucaaaucua

SEQ ID NO: 2989 - RNA, 20 nt, Artificial Sequence
  spacer sequence
uucaaaucuagggguccgua

SEQ ID NO: 2990 - RNA, 20 nt, Artificial Sequence
  spacer sequence
aaucuagggguccguagauu

SEQ ID NO: 2991 - RNA, 20 nt, Artificial Sequence
  spacer sequence
agggguccguagauugacca

SEQ ID NO: 2992 - RNA, 20 nt, Artificial Sequence
  spacer sequence
guagauugaccaccuaagac

SEQ ID NO: 2993 - RNA, 20 nt, Artificial Sequence
  spacer sequence
acggaccccuagauuugaaa

SEQ ID NO: 2994 - RNA, 20 nt, Artificial Sequence
  spacer sequence
aucuacggaccccuagauuu

SEQ ID NO: 2995 - RNA, 20 nt, Artificial Sequence
  spacer sequence
uagguggucaaucuacggac

SEQ ID NO: 2996 - RNA, 20 nt, Artificial Sequence
  spacer sequence
caguggccauuucauaguug

SEQ ID NO: 2997 - RNA, 20 nt, Artificial Sequence
  spacer sequence
uaguuggcucacucuuucuc

SEQ ID NO: 2998 - RNA, 20 nt, Artificial Sequence
  spacer sequence
cucuuucuccagcaugaacg

SEQ ID NO: 2999 - RNA, 20 nt, Artificial Sequence
  spacer sequence
uucuccagcaugaacgugac

SEQ ID NO: 3000 - RNA, 20 nt, Artificial Sequence
  spacer sequence
ccagcaugaacgugacauga

SEQ ID NO: 3001 - RNA, 20 nt, Artificial Sequence
  spacer sequence
agcaugaacgugacaugauc

SEQ ID NO: 3002 - RNA, 20 nt, Artificial Sequence
  spacer sequence
ugcuggagaaagagugagcc

SEQ ID NO: 3003 - RNA, 20 nt, Artificial Sequence
  spacer sequence
cguucaugcuggagaaagag

SEQ ID NO: 3004 - RNA, 20 nt, Artificial Sequence
  spacer sequence
ugucacguucaugcuggaga

SEQ ID NO: 3005 - RNA, 20 nt, Artificial Sequence
  spacer sequence
aaauuaugacugcccuucau

SEQ ID NO: 3006 - RNA, 20 nt, Artificial Sequence
  spacer sequence
uaauuuugaucaugucacgu

SEQ ID NO: 3007 - RNA, 20 nt, Artificial Sequence
  spacer sequence
uaagggucauucuggcugcc

SEQ ID NO: 3008 - RNA, 20 nt, Artificial Sequence
  spacer sequence
uucuggcugcccuaaaggga

SEQ ID NO: 3009 - RNA, 20 nt, Artificial Sequence
  spacer sequence
ggcugcccuaaagggacuuu

SEQ ID NO: 3010 - RNA, 20 nt, Artificial Sequence
  spacer sequence
cuuuagggcagccagaauga

SEQ ID NO: 3011 - RNA, 20 nt, Artificial Sequence
  spacer sequence
cuggcuuccaugccuacuca

SEQ ID NO: 3012 - RNA, 20 nt, Artificial Sequence
  spacer sequence
ggcuuccaugccuacucaau

SEQ ID NO: 3013 - RNA, 20 nt, Artificial Sequence
  spacer sequence
augccuacucaauuagaaac

SEQ ID NO: 3014 - RNA, 20 nt, Artificial Sequence
  spacer sequence
auuagaaacuuuccaucuuu

SEQ ID NO: 3015 - RNA, 20 nt, Artificial Sequence
  spacer sequence
aauugaguaggcauggaagc

SEQ ID NO: 3016 - RNA, 20 nt, Artificial Sequence
  spacer sequence
aucuuuguccaguuuuaaca

SEQ ID NO: 3017 - RNA, 20 nt, Artificial Sequence
  spacer sequence
uuguccaguuuuaacagacu

SEQ ID NO: 3018 - RNA, 20 nt, Artificial Sequence
  spacer sequence
aguuuuaacagacugagauc

SEQ ID NO: 3019 - RNA, 20 nt, Artificial Sequence
  spacer sequence
guuaaaacuggacaaagaug

SEQ ID NO: 3020 - RNA, 20 nt, Artificial Sequence
  spacer sequence
gucuguuaaaacuggacaaa

SEQ ID NO: 3021 - RNA, 20 nt, Artificial Sequence
  spacer sequence
cagucuguuaaaacuggaca

SEQ ID NO: 3022 - RNA, 20 nt, Artificial Sequence
  spacer sequence
uggccaagccuaaaaucuga

SEQ ID NO: 3023 - RNA, 20 nt, Artificial Sequence
  spacer sequence
gagguucucaccuaucaucu

SEQ ID NO: 3024 - RNA, 20 nt, Artificial Sequence
  spacer sequence
gauuuuaggcuuggccaaga

SEQ ID NO: 3025 - RNA, 20 nt, Artificial Sequence
  spacer sequence
caccuaucaucuccaugaau

SEQ ID NO: 3026 - RNA, 20 nt, Artificial Sequence
  spacer sequence
ccuaucaucuccaugaauga

SEQ ID NO: 3027 - RNA, 20 nt, Artificial Sequence
  spacer sequence
ucuccaugaaugaacaacaa

SEQ ID NO: 3028 - RNA, 20 nt, Artificial Sequence
  spacer sequence
ccaugaaugaacaacaaaua

SEQ ID NO: 3029 - RNA, 20 nt, Artificial Sequence
  spacer sequence
augaaugaacaacaaauacu

SEQ ID NO: 3030 - RNA, 20 nt, Artificial Sequence
  spacer sequence
uggagaugauaggugagaac

SEQ ID NO: 3031 - RNA, 20 nt, Artificial Sequence
  spacer sequence
uucauggagaugauagguga

SEQ ID NO: 3032 - RNA, 20 nt, Artificial Sequence
  spacer sequence
gcaaaguagguaguauuugu

SEQ ID NO: 3033 - RNA, 20 nt, Artificial Sequence
  spacer sequence
augacucaaauauccuuuca

SEQ ID NO: 3034 - RNA, 20 nt, Artificial Sequence
  spacer sequence
uagaaaucagcaaaguaggu

SEQ ID NO: 3035 - RNA, 20 nt, Artificial Sequence
  spacer sequence
aauauccuuucauuagcaaa

SEQ ID NO: 3036 - RNA, 20 nt, Artificial Sequence
  spacer sequence
uuucauuagcaaaaugcgga

SEQ ID NO: 3037 - RNA, 20 nt, Artificial Sequence
  spacer sequence
uuagcaaaaugcggaauuac

SEQ ID NO: 3038 - RNA, 20 nt, Artificial Sequence
  spacer sequence
gcauuuugcuaaugaaagga

SEQ ID NO: 3039 - RNA, 20 nt, Artificial Sequence
  spacer sequence
guaauuccgcauuuugcuaa

SEQ ID NO: 3040 - RNA, 20 nt, Artificial Sequence
  spacer sequence
auucuguaauuccgcauuuu

SEQ ID NO: 3041 - RNA, 20 nt, Artificial Sequence
  spacer sequence
aaacaaaaugcaagcugcuu

SEQ ID NO: 3042 - RNA, 20 nt, Artificial Sequence
  spacer sequence
auaucaaaacaaaaugcaag

SEQ ID NO: 3043 - RNA, 20 nt, Artificial Sequence
  spacer sequence
ucaaauauuuauuagaguug

SEQ ID NO: 3044 - RNA, 20 nt, Artificial Sequence
  spacer sequence
aauauuuauuagaguugacu

SEQ ID NO: 3045 - RNA, 20 nt, Artificial Sequence
  spacer sequence
aauaaauauuugaugaauaa

SEQ ID NO: 3046 - RNA, 20 nt, Artificial Sequence
  spacer sequence
acucuaauaaauauuugaug

SEQ ID NO: 3047 - RNA, 20 nt, Artificial Sequence
  spacer sequence
gugcuggcacuaugccugga

SEQ ID NO: 3048 - RNA, 20 nt, Artificial Sequence
  spacer sequence
aggcauagugccagcacaga

SEQ ID NO: 3049 - RNA, 20 nt, Artificial Sequence
  spacer sequence
aguccaggcauagugccagc

SEQ ID NO: 3050 - RNA, 20 nt, Artificial Sequence
  spacer sequence
uuauuaaaccuccaguccag

SEQ ID NO: 3051 - RNA, 20 nt, Artificial Sequence
  spacer sequence
uguucauuauuaaaccucca

SEQ ID NO: 3052 - RNA, 20 nt, Artificial Sequence
  spacer sequence
aauuuaaccuugccugucuu

SEQ ID NO: 3053 - RNA, 20 nt, Artificial Sequence
  spacer sequence
ucaaauuuaaccuugccugu

SEQ ID NO: 3054 - RNA, 20 nt, Artificial Sequence
  spacer sequence
ggccuuucgucaaauuuaac

SEQ ID NO: 3055 - RNA, 20 nt, Artificial Sequence
  spacer sequence
ccgcaucuggccuuucguca

SEQ ID NO: 3056 - RNA, 20 nt, Artificial Sequence
  spacer sequence
ugccuguaauccuagcacuu

SEQ ID NO: 3057 - RNA, 20 nt, Artificial Sequence
  spacer sequence
uagcacuuugagaggccaag

SEQ ID NO: 3058 - RNA, 20 nt, Artificial Sequence
  spacer sequence
aagugcuaggauuacaggca

SEQ ID NO: 3059 - RNA, 20 nt, Artificial Sequence
  spacer sequence
caaagugcuaggauuacagg

SEQ ID NO: 3060 - RNA, 20 nt, Artificial Sequence
  spacer sequence
acccgccuuggccucucaaa

SEQ ID NO: 3061 - RNA, 20 nt, Artificial Sequence
  spacer sequence
cuuaagcccaggagcucgag

SEQ ID NO: 3062 - RNA, 20 nt, Artificial Sequence
  spacer sequence
ugggcuuaagcgauccaccc

SEQ ID NO: 3063 - RNA, 20 nt, Artificial Sequence
  spacer sequence
agaccugccugggcaacaug

SEQ ID NO: 3064 - RNA, 20 nt, Artificial Sequence
  spacer sequence
agcuccugggcuuaagcgau

SEQ ID NO: 3065 - RNA, 20 nt, Artificial Sequence
  spacer sequence
cgagcuccugggcuuaagcg

SEQ ID NO: 3066 - RNA, 20 nt, Artificial Sequence
  spacer sequence
ugccauguugcccaggcagg

SEQ ID NO: 3067 - RNA, 20 nt, Artificial Sequence
  spacer sequence
ucucuacaaaaaauacaaaa

SEQ ID NO: 3068 - RNA, 20 nt, Artificial Sequence
  spacer sequence
cuacaaaaaauacaaaaauu

SEQ ID NO: 3069 - RNA, 20 nt, Artificial Sequence
  spacer sequence
acaaaaaauacaaaaauuag

SEQ ID NO: 3070 - RNA, 20 nt, Artificial Sequence
  spacer sequence
cagcuacuuggaagacugag

SEQ ID NO: 3071 - RNA, 20 nt, Artificial Sequence
  spacer sequence
aaguagcugggacuacaggc

SEQ ID NO: 3072 - RNA, 20 nt, Artificial Sequence
  spacer sequence
uccaaguagcugggacuaca

SEQ ID NO: 3073 - RNA, 20 nt, Artificial Sequence
  spacer sequence
gucuuccaaguagcugggac

SEQ ID NO: 3074 - RNA, 20 nt, Artificial Sequence
  spacer sequence
caccucagucuuccaaguag

SEQ ID NO: 3075 - RNA, 20 nt, Artificial Sequence
  spacer sequence
uuuaagucugggaggcagug

SEQ ID NO: 3076 - RNA, 20 nt, Artificial Sequence
  spacer sequence
gggaggcagugagcugagac

SEQ ID NO: 3077 - RNA, 20 nt, Artificial Sequence
  spacer sequence
cagacuuaaaggaacuuccc

SEQ ID NO: 3078 - RNA, 20 nt, Artificial Sequence
  spacer sequence
cugccucccagacuuaaagg

SEQ ID NO: 3079 - RNA, 20 nt, Artificial Sequence
  spacer sequence
gcucacugccucccagacuu

SEQ ID NO: 3080 - RNA, 20 nt, Artificial Sequence
  spacer sequence
cagcucacugccucccagac

SEQ ID NO: 3081 - RNA, 20 nt, Artificial Sequence
  spacer sequence
agccugggagacagagugag

SEQ ID NO: 3082 - RNA, 20 nt, Artificial Sequence
  spacer sequence
caggcuggagugcaguggca

SEQ ID NO: 3083 - RNA, 20 nt, Artificial Sequence
  spacer sequence
cccaggcuggagugcagugg

SEQ ID NO: 3084 - RNA, 20 nt, Artificial Sequence
  spacer sequence
gucucccaggcuggagugca

SEQ ID NO: 3085 - RNA, 20 nt, Artificial Sequence
  spacer sequence
cucugucucccaggcuggag

SEQ ID NO: 3086 - RNA, 20 nt, Artificial Sequence
  spacer sequence
cacucugucucccaggcugg

SEQ ID NO: 3087 - RNA, 20 nt, Artificial Sequence
  spacer sequence
caaaaaacaaauggacaaaa

SEQ ID NO: 3088 - RNA, 20 nt, Artificial Sequence
  spacer sequence
aaaaacaaauggacaaaaga

SEQ ID NO: 3089 - RNA, 20 nt, Artificial Sequence
  spacer sequence
auuuguuuuuugagacaagg

SEQ ID NO: 3090 - RNA, 20 nt, Artificial Sequence
  spacer sequence
uuuguccauuuguuuuuuga

SEQ ID NO: 3091 - RNA, 20 nt, Artificial Sequence
  spacer sequence
cagggguaucuuuuguccau

SEQ ID NO: 3092 - RNA, 20 nt, Artificial Sequence
  spacer sequence
guucuggaggaaaaaauucu

SEQ ID NO: 3093 - RNA, 20 nt, Artificial Sequence
  spacer sequence
ggaggaaaaaauucucuagg

SEQ ID NO: 3094 - RNA, 20 nt, Artificial Sequence
  spacer sequence
agaacugaaagcuagcucac

SEQ ID NO: 3095 - RNA, 20 nt, Artificial Sequence
  spacer sequence
uccagaacugaaagcuagcu

SEQ ID NO: 3096 - RNA, 20 nt, Artificial Sequence
  spacer sequence
cuaggaacugaaaaucuuaa

SEQ ID NO: 3097 - RNA, 20 nt, Artificial Sequence
  spacer sequence
aggaacugaaaaucuuaacu

SEQ ID NO: 3098 - RNA, 20 nt, Artificial Sequence
  spacer sequence
uagagaauuuuuuccuccag

SEQ ID NO: 3099 - RNA, 20 nt, Artificial Sequence
  spacer sequence
guuccuagagaauuuuuucc

SEQ ID NO: 3100 - RNA, 20 nt, Artificial Sequence
  spacer sequence
uaacuuagucuccaugauaa

SEQ ID NO: 3101 - RNA, 20 nt, Artificial Sequence
  spacer sequence
ccaugauaacugaaucuuac

SEQ ID NO: 3102 - RNA, 20 nt, Artificial Sequence
  spacer sequence
augauaacugaaucuuaccu

SEQ ID NO: 3103 - RNA, 20 nt, Artificial Sequence
  spacer sequence
uggagacuaaguuaagauuu

SEQ ID NO: 3104 - RNA, 20 nt, Artificial Sequence
  spacer sequence
guuaucauggagacuaaguu

SEQ ID NO: 3105 - RNA, 20 nt, Artificial Sequence
  spacer sequence
uaccucuuguaaaauuugcc

SEQ ID NO: 3106 - RNA, 20 nt, Artificial Sequence
  spacer sequence
uguaaaauuugccuuaauag

SEQ ID NO: 3107 - RNA, 20 nt, Artificial Sequence
  spacer sequence
aacauaaaaauuuuaaaugc

SEQ ID NO: 3108 - RNA, 20 nt, Artificial Sequence
  spacer sequence
uuuuggaacucggguuccaa

SEQ ID NO: 3109 - RNA, 20 nt, Artificial Sequence
  spacer sequence
aaaaugaaauaaaauaaauc

SEQ ID NO: 3110 - RNA, 20 nt, Artificial Sequence
  spacer sequence
gguuccaaagguagauuuaa

SEQ ID NO: 3111 - RNA, 20 nt, Artificial Sequence
  spacer sequence
aaagguagauuuaaucauac

SEQ ID NO: 3112 - RNA, 20 nt, Artificial Sequence
  spacer sequence
accuuuggaacccgaguucc

SEQ ID NO: 3113 - RNA, 20 nt, Artificial Sequence
  spacer sequence
ggugaggauaugaagaaacu

SEQ ID NO: 3114 - RNA, 20 nt, Artificial Sequence
  spacer sequence
uuugucugauaauagccauc

SEQ ID NO: 3115 - RNA, 20 nt, Artificial Sequence
  spacer sequence
gauaauagccauccugacag

SEQ ID NO: 3116 - RNA, 20 nt, Artificial Sequence
  spacer sequence
gacaaaagacaaaaagcucu

SEQ ID NO: 3117 - RNA, 20 nt, Artificial Sequence
  spacer sequence
ugacagguguaaggugauau

SEQ ID NO: 3118 - RNA, 20 nt, Artificial Sequence
  spacer sequence
ggauggcuauuaucagacaa

SEQ ID NO: 3119 - RNA, 20 nt, Artificial Sequence
  spacer sequence
ccuuacaccugucaggaugg

SEQ ID NO: 3120 - RNA, 20 nt, Artificial Sequence
  spacer sequence
cauugugguuuggauuugca

SEQ ID NO: 3121 - RNA, 20 nt, Artificial Sequence
  spacer sequence
uugugguuuggauuugcauu

SEQ ID NO: 3122 - RNA, 20 nt, Artificial Sequence
  spacer sequence
aaaccacaaugagauaucac

SEQ ID NO: 3123 - RNA, 20 nt, Artificial Sequence
  spacer sequence
uugaugguuagugacauagu

SEQ ID NO: 3124 - RNA, 20 nt, Artificial Sequence
  spacer sequence
aagaaaugcaaauccaaacc

SEQ ID NO: 3125 - RNA, 20 nt, Artificial Sequence
  spacer sequence
cuaaccaucaaagaaaugca

SEQ ID NO: 3126 - RNA, 20 nt, Artificial Sequence
  spacer sequence
aaacuaugucacuaaccauc

SEQ ID NO: 3127 - RNA, 20 nt, Artificial Sequence
  spacer sequence
ccacucaaaucucagguuga

SEQ ID NO: 3128 - RNA, 20 nt, Artificial Sequence
  spacer sequence
aaucucagguugaauuguaa

SEQ ID NO: 3129 - RNA, 20 nt, Artificial Sequence
  spacer sequence
cagguugaauuguaaucccc

SEQ ID NO: 3130 - RNA, 20 nt, Artificial Sequence
  spacer sequence
gguugaauuguaauccccaa

SEQ ID NO: 3131 - RNA, 20 nt, Artificial Sequence
  spacer sequence
accugagauuugagugggga

SEQ ID NO: 3132 - RNA, 20 nt, Artificial Sequence
  spacer sequence
ccaaugcuggagguggggcc

SEQ ID NO: 3133 - RNA, 20 nt, Artificial Sequence
  spacer sequence
agcauuggggauuacaauuc

SEQ ID NO: 3134 - RNA, 20 nt, Artificial Sequence
  spacer sequence
ucaaaauaguaaaugagguc

SEQ ID NO: 3135 - RNA, 20 nt, Artificial Sequence
  spacer sequence
aaauaguaaaugaggucuca

SEQ ID NO: 3136 - RNA, 20 nt, Artificial Sequence
  spacer sequence
uuuacuauuuugaagauagc

SEQ ID NO: 3137 - RNA, 20 nt, Artificial Sequence
  spacer sequence
cacaggaucugguugugugg

SEQ ID NO: 3138 - RNA, 20 nt, Artificial Sequence
  spacer sequence
caggaucugguuguguggcu

SEQ ID NO: 3139 - RNA, 20 nt, Artificial Sequence
  spacer sequence
ugugagaccucauuuacuau

SEQ ID NO: 3140 - RNA, 20 nt, Artificial Sequence
  spacer sequence
gguuguguggcuuugggagg

SEQ ID NO: 3141 - RNA, 20 nt, Artificial Sequence
  spacer sequence
caaagccacacaaccagauc

SEQ ID NO: 3142 - RNA, 20 nt, Artificial Sequence
  spacer sequence
accaccccagccucccaaag

SEQ ID NO: 3143 - RNA, 20 nt, Artificial Sequence
  spacer sequence
cuugagcccaggaguuugag

SEQ ID NO: 3144 - RNA, 20 nt, Artificial Sequence
  spacer sequence
ugagcccaggaguuugagac

SEQ ID NO: 3145 - RNA, 20 nt, Artificial Sequence
  spacer sequence
agagauccaccaccccagcc

SEQ ID NO: 3146 - RNA, 20 nt, Artificial Sequence
  spacer sequence
ugggcucaagagauccacca

SEQ ID NO: 3147 - RNA, 20 nt, Artificial Sequence
  spacer sequence
aacuccugggcucaagagau

SEQ ID NO: 3148 - RNA, 20 nt, Artificial Sequence
  spacer sequence
caaacuccugggcucaagag

SEQ ID NO: 3149 - RNA, 20 nt, Artificial Sequence
  spacer sequence
ccauguugcccaggcugguc

SEQ ID NO: 3150 - RNA, 20 nt, Artificial Sequence
  spacer sequence
cugcagccuugacuucccug

SEQ ID NO: 3151 - RNA, 20 nt, Artificial Sequence
  spacer sequence
gcucacugcagccuugacuu

SEQ ID NO: 3152 - RNA, 20 nt, Artificial Sequence
  spacer sequence
cggcucacugcagccuugac

SEQ ID NO: 3153 - RNA, 20 nt, Artificial Sequence
  spacer sequence
ugccacugcacuccagccug

SEQ ID NO: 3154 - RNA, 20 nt, Artificial Sequence
  spacer sequence
agccugggugacagagcaag

SEQ ID NO: 3155 - RNA, 20 nt, Artificial Sequence
  spacer sequence
cccaggcuggagugcagugg

SEQ ID NO: 3156 - RNA, 20 nt, Artificial Sequence
  spacer sequence
gucacccaggcuggagugca

SEQ ID NO: 3157 - RNA, 20 nt, Artificial Sequence
  spacer sequence
ugcucugucacccaggcugg

SEQ ID NO: 3158 - RNA, 20 nt, Artificial Sequence
  spacer sequence
aaaaaaaaaaaaauugugug

SEQ ID NO: 3159 - RNA, 20 nt, Artificial Sequence
  spacer sequence
uaagacuggguuauauauaa

SEQ ID NO: 3160 - RNA, 20 nt, Artificial Sequence
  spacer sequence
uuauaguagugcaagaacag

SEQ ID NO: 3161 - RNA, 20 nt, Artificial Sequence
  spacer sequence
ugcacuacuauaaagaaauc

SEQ ID NO: 3162 - RNA, 20 nt, Artificial Sequence
  spacer sequence
cuaauuguguaaggcuguuc

SEQ ID NO: 3163 - RNA, 20 nt, Artificial Sequence
  spacer sequence
gucacuaauuguguaaggcu

SEQ ID NO: 3164 - RNA, 20 nt, Artificial Sequence
  spacer sequence
uucuguugggcauuuggaug

SEQ ID NO: 3165 - RNA, 20 nt, Artificial Sequence
  spacer sequence
guugggcauuuggauggcuu

SEQ ID NO: 3166 - RNA, 20 nt, Artificial Sequence
  spacer sequence
aaaugcccaacagaaagaca

SEQ ID NO: 3167 - RNA, 20 nt, Artificial Sequence
  spacer sequence
uuggagaacugucuauucaa

SEQ ID NO: 3168 - RNA, 20 nt, Artificial Sequence
  spacer sequence
aaagaagccauccaaaugcc

SEQ ID NO: 3169 - RNA, 20 nt, Artificial Sequence
  spacer sequence
ccaaagaagccauccaaaug

SEQ ID NO: 3170 - RNA, 20 nt, Artificial Sequence
  spacer sequence
auucaagucuuuagcccauu

SEQ ID NO: 3171 - RNA, 20 nt, Artificial Sequence
  spacer sequence
agucuuuagcccauuuuaaa

SEQ ID NO: 3172 - RNA, 20 nt, Artificial Sequence
  spacer sequence
uuagcccauuuuaaaauugg

SEQ ID NO: 3173 - RNA, 20 nt, Artificial Sequence
  spacer sequence
uuauuuuuuuugcuaucaag

SEQ ID NO: 3174 - RNA, 20 nt, Artificial Sequence
  spacer sequence
aguuguagguagucccuaug

SEQ ID NO: 3175 - RNA, 20 nt, Artificial Sequence
  spacer sequence
cuauguauuuuggaaauuau

SEQ ID NO: 3176 - RNA, 20 nt, Artificial Sequence
  spacer sequence
ugcuauuagucuuggcagcg

SEQ ID NO: 3177 - RNA, 20 nt, Artificial Sequence
  spacer sequence
ucaugcuauuagucuuggca

SEQ ID NO: 3178 - RNA, 20 nt, Artificial Sequence
  spacer sequence
ccuauguguucuucuacgag

SEQ ID NO: 3179 - RNA, 20 nt, Artificial Sequence
  spacer sequence
ucuacgaguuuuauaguuua

SEQ ID NO: 3180 - RNA, 20 nt, Artificial Sequence
  spacer sequence
acgaguuuuauaguuuaggu

SEQ ID NO: 3181 - RNA, 20 nt, Artificial Sequence
  spacer sequence
uagaagaacacauaggggaa

SEQ ID NO: 3182 - RNA, 20 nt, Artificial Sequence
  spacer sequence
aauauuuaagucuuuaaucc

SEQ ID NO: 3183 - RNA, 20 nt, Artificial Sequence
  spacer sequence
uuaauccauuuuuaguugau

SEQ ID NO: 3184 - RNA, 20 nt, Artificial Sequence
  spacer sequence
auuuuuaguugauuuuuggg

SEQ ID NO: 3185 - RNA, 20 nt, Artificial Sequence
  spacer sequence
acuaaaaauggauuaaagac

SEQ ID NO: 3186 - RNA, 20 nt, Artificial Sequence
  spacer sequence
caaaaaucaacuaaaaaugg

SEQ ID NO: 3187 - RNA, 20 nt, Artificial Sequence
  spacer sequence
cagccuuaauuuacacuauc

SEQ ID NO: 3188 - RNA, 20 nt, Artificial Sequence
  spacer sequence
uucuuuuagaugugaauauc

SEQ ID NO: 3189 - RNA, 20 nt, Artificial Sequence
  spacer sequence
uuuagaugugaauauccagu

SEQ ID NO: 3190 - RNA, 20 nt, Artificial Sequence
  spacer sequence
ggaagugugaugccuucagc

SEQ ID NO: 3191 - RNA, 20 nt, Artificial Sequence
  spacer sequence
ugauuacaaaauauuuuaca

SEQ ID NO: 3192 - RNA, 20 nt, Artificial Sequence
  spacer sequence
cacuuccugauuacaaaaua

SEQ ID NO: 3193 - RNA, 20 nt, Artificial Sequence
  spacer sequence
gcuuugcucuucauuuucaa

SEQ ID NO: 3194 - RNA, 20 nt, Artificial Sequence
  spacer sequence
ucauuuucaagauuaguuug

SEQ ID NO: 3195 - RNA, 20 nt, Artificial Sequence
  spacer sequence
uuuucaagauuaguuuggcu

SEQ ID NO: 3196 - RNA, 20 nt, Artificial Sequence
  spacer sequence
agauuaguuuggcuauuugg

SEQ ID NO: 3197 - RNA, 20 nt, Artificial Sequence
  spacer sequence
ugaaaaugaagagcaaagcu

SEQ ID NO: 3198 - RNA, 20 nt, Artificial Sequence
  spacer sequence
uuuuuggccucacaugaauu

SEQ ID NO: 3199 - RNA, 20 nt, Artificial Sequence
  spacer sequence
caugaauuuuagaauugcuu

SEQ ID NO: 3200 - RNA, 20 nt, Artificial Sequence
  spacer sequence
ugugaggccaaaaaagaccc

SEQ ID NO: 3201 - RNA, 20 nt, Artificial Sequence
  spacer sequence
aaaauucaugugaggccaaa

SEQ ID NO: 3202 - RNA, 20 nt, Artificial Sequence
  spacer sequence
aaacugcaauggcauuuuuu

SEQ ID NO: 3203 - RNA, 20 nt, Artificial Sequence
  spacer sequence
cuaucaaaacugcaauggca

SEQ ID NO: 3204 - RNA, 20 nt, Artificial Sequence
  spacer sequence
aucuguagaugacuuugggu

SEQ ID NO: 3205 - RNA, 20 nt, Artificial Sequence
  spacer sequence
guagaugacuuuggguagca

SEQ ID NO: 3206 - RNA, 20 nt, Artificial Sequence
  spacer sequence
acagauugaaugcauucccu

SEQ ID NO: 3207 - RNA, 20 nt, Artificial Sequence
  spacer sequence
ucuacagauugaaugcauuc

SEQ ID NO: 3208 - RNA, 20 nt, Artificial Sequence
  spacer sequence
aaugcuacccaaagucaucu

SEQ ID NO: 3209 - RNA, 20 nt, Artificial Sequence
  spacer sequence
aauccaugaccaugggaagu

SEQ ID NO: 3210 - RNA, 20 nt, Artificial Sequence
  spacer sequence
augaccaugggaagucuuuc

SEQ ID NO: 3211 - RNA, 20 nt, Artificial Sequence
  spacer sequence
uggauuagaaaacuuaaugu

SEQ ID NO: 3212 - RNA, 20 nt, Artificial Sequence
  spacer sequence
cauggucauggauuagaaaa

SEQ ID NO: 3213 - RNA, 20 nt, Artificial Sequence
  spacer sequence
uuccauuuauuuggaucuuc

SEQ ID NO: 3214 - RNA, 20 nt, Artificial Sequence
  spacer sequence
auuuauuuggaucuucuuca

SEQ ID NO: 3215 - RNA, 20 nt, Artificial Sequence
  spacer sequence
aaauaaauggaaagacuucc

SEQ ID NO: 3216 - RNA, 20 nt, Artificial Sequence
  spacer sequence
ucuucaauuucauuuaucaa

SEQ ID NO: 3217 - RNA, 20 nt, Artificial Sequence
  spacer sequence
uaaauauugaacggggucuu

SEQ ID NO: 3218 - RNA, 20 nt, Artificial Sequence
  spacer sequence
auauuuaggaacaaauuuaa

SEQ ID NO: 3219 - RNA, 20 nt, Artificial Sequence
  spacer sequence
ugcuauguugccuaggcugg

SEQ ID NO: 3220 - RNA, 20 nt, Artificial Sequence
  spacer sequence
ugaacuccugagcucaagcg

SEQ ID NO: 3221 - RNA, 20 nt, Artificial Sequence
  spacer sequence
agaccagccuaggcaacaua

SEQ ID NO: 3222 - RNA, 20 nt, Artificial Sequence
  spacer sequence
ugagcucaagcgauacuccc

SEQ ID NO: 3223 - RNA, 20 nt, Artificial Sequence
  spacer sequence
ggaguucaagaccagccuag

SEQ ID NO: 3224 - RNA, 20 nt, Artificial Sequence
  spacer sequence
agcgauacucccaccucagc

SEQ ID NO: 3225 - RNA, 20 nt, Artificial Sequence
  spacer sequence
cuugagcucaggaguucaag

SEQ ID NO: 3226 - RNA, 20 nt, Artificial Sequence
  spacer sequence
caccucagccuuugugaccu

SEQ ID NO: 3227 - RNA, 20 nt, Artificial Sequence
  spacer sequence
gccuuugugaccugcccgcc

SEQ ID NO: 3228 - RNA, 20 nt, Artificial Sequence
  spacer sequence
caaaggcugaggugggagua

SEQ ID NO: 3229 - RNA, 20 nt, Artificial Sequence
  spacer sequence
gccucccaaagugcugggau

SEQ ID NO: 3230 - RNA, 20 nt, Artificial Sequence
  spacer sequence
caaagugcugggauuacagg

SEQ ID NO: 3231 - RNA, 20 nt, Artificial Sequence
  spacer sequence
cagguucacgccacuucuuc

SEQ ID NO: 3232 - RNA, 20 nt, Artificial Sequence
  spacer sequence
cgccacuucuucuaguuuuu

SEQ ID NO: 3233 - RNA, 20 nt, Artificial Sequence
  spacer sequence
ucuaguuuuuugagauguaa

SEQ ID NO: 3234 - RNA, 20 nt, Artificial Sequence
  spacer sequence
aguuuuuugagauguaaagu

SEQ ID NO: 3235 - RNA, 20 nt, Artificial Sequence
  spacer sequence
aaaaacuagaagaaguggcg

SEQ ID NO: 3236 - RNA, 20 nt, Artificial Sequence
  spacer sequence
caaaaaacuagaagaagugg

SEQ ID NO: 3237 - RNA, 20 nt, Artificial Sequence
  spacer sequence
aacaaccaaacuuuacaucu

SEQ ID NO: 3238 - RNA, 20 nt, Artificial Sequence
  spacer sequence
caaacaaccaaacuuuacau

SEQ ID NO: 3239 - RNA, 20 nt, Artificial Sequence
  spacer sequence
ucuuuuuaauauaggcauuc

SEQ ID NO: 3240 - RNA, 20 nt, Artificial Sequence
  spacer sequence
uuuuaauauaggcauucauu

SEQ ID NO: 3241 - RNA, 20 nt, Artificial Sequence
  spacer sequence
uugcuauaaacuuccccguu

SEQ ID NO: 3242 - RNA, 20 nt, Artificial Sequence
  spacer sequence
gucuuggccucccaaagugc

SEQ ID NO: 3243 - RNA, 20 nt, Artificial Sequence
  spacer sequence
uggccucccaaagugcuggg

SEQ ID NO: 3244 - RNA, 20 nt, Artificial Sequence
  spacer sequence
caaagugcugggauuacagg

SEQ ID NO: 3245 - RNA, 20 nt, Artificial Sequence
  spacer sequence
cagcacuuugggaggccaag

SEQ ID NO: 3246 - RNA, 20 nt, Artificial Sequence
  spacer sequence
caccuguaaucccagcacuu

SEQ ID NO: 3247 - RNA, 20 nt, Artificial Sequence
  spacer sequence
acauaccagcugggugcagu

SEQ ID NO: 3248 - RNA, 20 nt, Artificial Sequence
  spacer sequence
auuucuauucaucuuaagau

SEQ ID NO: 3249 - RNA, 20 nt, Artificial Sequence
  spacer sequence
auucaucuuaagauuuuuuu

SEQ ID NO: 3250 - RNA, 20 nt, Artificial Sequence
  spacer sequence
ucuuaagauuuuuuuugauu

SEQ ID NO: 3251 - RNA, 20 nt, Artificial Sequence
  spacer sequence
uaagauuuuuuuugauuuac

SEQ ID NO: 3252 - RNA, 20 nt, Artificial Sequence
  spacer sequence
uaagaugaauagaaauggaa

SEQ ID NO: 3253 - RNA, 20 nt, Artificial Sequence
  spacer sequence
aaaaaaaaaaaaaaaaaaaa

SEQ ID NO: 3254 - RNA, 20 nt, Artificial Sequence
  spacer sequence
caaaaaaaaaaaaaaaaaaa

SEQ ID NO: 3255 - RNA, 20 nt, Artificial Sequence
  spacer sequence
gucucaaaaaaaaaaaaaaa

SEQ ID NO: 3256 - RNA, 20 nt, Artificial Sequence
  spacer sequence
ugcugucccaggcuggagug

SEQ ID NO: 3257 - RNA, 20 nt, Artificial Sequence
  spacer sequence
caggcuggagugcaguggug

SEQ ID NO: 3258 - RNA, 20 nt, Artificial Sequence
  spacer sequence
agccugggacagcaagacuc

SEQ ID NO: 3259 - RNA, 20 nt, Artificial Sequence
  spacer sequence
cugaagccucaguccuccag

SEQ ID NO: 3260 - RNA, 20 nt, Artificial Sequence
  spacer sequence
gugagccauaauugcaccac

SEQ ID NO: 3261 - RNA, 20 nt, Artificial Sequence
  spacer sequence
guccuccaggcucaagcgau

SEQ ID NO: 3262 - RNA, 20 nt, Artificial Sequence
  spacer sequence
uccaggcucaagcgauccuc

SEQ ID NO: 3263 - RNA, 20 nt, Artificial Sequence
  spacer sequence
aggcucaagcgauccucuug

SEQ ID NO: 3264 - RNA, 20 nt, Artificial Sequence
  spacer sequence
agcgauccucuugccucagc

SEQ ID NO: 3265 - RNA, 20 nt, Artificial Sequence
  spacer sequence
uuucuuccuuuuuuuuuuuu

SEQ ID NO: 3266 - RNA, 20 nt, Artificial Sequence
  spacer sequence
uccuuuuuuuuuuuuuuagu

SEQ ID NO: 3267 - RNA, 20 nt, Artificial Sequence
  spacer sequence
uuuuuuuuuuuuuuaguaga

SEQ ID NO: 3268 - RNA, 20 nt, Artificial Sequence
  spacer sequence
acuaaaaaaaaaaaaaagga

SEQ ID NO: 3269 - RNA, 20 nt, Artificial Sequence
  spacer sequence
cuacuaaaaaaaaaaaaaag

SEQ ID NO: 3270 - RNA, 20 nt, Artificial Sequence
  spacer sequence
ucucuacuaaaaaaaaaaaa

SEQ ID NO: 3271 - RNA, 20 nt, Artificial Sequence
  spacer sequence
caucucuacuaaaaaaaaaa

SEQ ID NO: 3272 - RNA, 20 nt, Artificial Sequence
  spacer sequence
cuuuguugcccaggcugguc

SEQ ID NO: 3273 - RNA, 20 nt, Artificial Sequence
  spacer sequence
ugaacuccugagcucaagug

SEQ ID NO: 3274 - RNA, 20 nt, Artificial Sequence
  spacer sequence
agaccagccugggcaacaaa

SEQ ID NO: 3275 - RNA, 20 nt, Artificial Sequence
  spacer sequence
ugagcucaagugauccuccu

SEQ ID NO: 3276 - RNA, 20 nt, Artificial Sequence
  spacer sequence
ggaguucaagaccagccugg

SEQ ID NO: 3277 - RNA, 20 nt, Artificial Sequence
  spacer sequence
agugauccuccugcuuuggc

SEQ ID NO: 3278 - RNA, 20 nt, Artificial Sequence
  spacer sequence
cuugagcucaggaguucaag

SEQ ID NO: 3279 - RNA, 20 nt, Artificial Sequence
  spacer sequence
uccugcuuuggccucccaaa

SEQ ID NO: 3280 - RNA, 20 nt, Artificial Sequence
  spacer sequence
ugcuuuggccucccaaagug

SEQ ID NO: 3281 - RNA, 20 nt, Artificial Sequence
  spacer sequence
caaagugcugggauuacagg

SEQ ID NO: 3282 - RNA, 20 nt, Artificial Sequence
  spacer sequence
gagcuguuuuuuucugcuau

SEQ ID NO: 3283 - RNA, 20 nt, Artificial Sequence
  spacer sequence
gaggccaggcaugguggcuc

SEQ ID NO: 3284 - RNA, 20 nt, Artificial Sequence
  spacer sequence
gcuauuggcuucuaguuuua

SEQ ID NO: 3285 - RNA, 20 nt, Artificial Sequence
  spacer sequence
aguuuuauuucacugugguc

SEQ ID NO: 3286 - RNA, 20 nt, Artificial Sequence
  spacer sequence
cuguggucagaaaagauacu

SEQ ID NO: 3287 - RNA, 20 nt, Artificial Sequence
  spacer sequence
gaaaagauacuugguaugac

SEQ ID NO: 3288 - RNA, 20 nt, Artificial Sequence
  spacer sequence
gaccacagugaaauaaaacu

SEQ ID NO: 3289 - RNA, 20 nt, Artificial Sequence
  spacer sequence
uuucugaccacagugaaaua

SEQ ID NO: 3290 - RNA, 20 nt, Artificial Sequence
  spacer sequence
uaccaaguaucuuuucugac

SEQ ID NO: 3291 - RNA, 20 nt, Artificial Sequence
  spacer sequence
gucuucuuaaacuuguuagg

SEQ ID NO: 3292 - RNA, 20 nt, Artificial Sequence
  spacer sequence
ucuuaaacuuguuaggacuu

SEQ ID NO: 3293 - RNA, 20 nt, Artificial Sequence
  spacer sequence
uaaacuuguuaggacuuguu

SEQ ID NO: 3294 - RNA, 20 nt, Artificial Sequence
  spacer sequence
uaacaaguuuaagaagacug

SEQ ID NO: 3295 - RNA, 20 nt, Artificial Sequence
  spacer sequence
ggagaauauuccacaugcac

SEQ ID NO: 3296 - RNA, 20 nt, Artificial Sequence
  spacer sequence
agaguaaauuguaguguuag

SEQ ID NO: 3297 - RNA, 20 nt, Artificial Sequence
  spacer sequence
ccagaguaaauuguaguguu

SEQ ID NO: 3298 - RNA, 20 nt, Artificial Sequence
  spacer sequence
acaugcacuugaaaaggaug

SEQ ID NO: 3299 - RNA, 20 nt, Artificial Sequence
  spacer sequence
agugcauguggaauauucuc

SEQ ID NO: 3300 - RNA, 20 nt, Artificial Sequence
  spacer sequence
uuuucaagugcauguggaau

SEQ ID NO: 3301 - RNA, 20 nt, Artificial Sequence
  spacer sequence
acauccuuuucaagugcaug

SEQ ID NO: 3302 - RNA, 20 nt, Artificial Sequence
  spacer sequence
gcugcuguuggguggaaugu

SEQ ID NO: 3303 - RNA, 20 nt, Artificial Sequence
  spacer sequence
acccaacagcagcagaaucc

SEQ ID NO: 3304 - RNA, 20 nt, Artificial Sequence
  spacer sequence
cuguaugucugucaggucca

SEQ ID NO: 3305 - RNA, 20 nt, Artificial Sequence
  spacer sequence
guaugucugucagguccauu

SEQ ID NO: 3306 - RNA, 20 nt, Artificial Sequence
  spacer sequence
gucagguccauuuaguguac

SEQ ID NO: 3307 - RNA, 20 nt, Artificial Sequence
  spacer sequence
gguccauuuaguguacagug

SEQ ID NO: 3308 - RNA, 20 nt, Artificial Sequence
  spacer sequence
auuuaguguacaguguucaa

SEQ ID NO: 3309 - RNA, 20 nt, Artificial Sequence
  spacer sequence
aaucauuuguuuccuuauca

SEQ ID NO: 3310 - RNA, 20 nt, Artificial Sequence
  spacer sequence
uuuguuuccuuaucaauagu

SEQ ID NO: 3311 - RNA, 20 nt, Artificial Sequence
  spacer sequence
uuaucaauagucuaucugga

SEQ ID NO: 3312 - RNA, 20 nt, Artificial Sequence
  spacer sequence
auagucuaucuggauguucu

SEQ ID NO: 3313 - RNA, 20 nt, Artificial Sequence
  spacer sequence
aucuggauguucuauccacu

SEQ ID NO: 3314 - RNA, 20 nt, Artificial Sequence
  spacer sequence
ggauguucuauccacuauug

SEQ ID NO: 3315 - RNA, 20 nt, Artificial Sequence
  spacer sequence
agauagacuauugauaagga

SEQ ID NO: 3316 - RNA, 20 nt, Artificial Sequence
  spacer sequence
auccacuauugaaagugggg

SEQ ID NO: 3317 - RNA, 20 nt, Artificial Sequence
  spacer sequence
acuauugaaagugggguauu

SEQ ID NO: 3318 - RNA, 20 nt, Artificial Sequence
  spacer sequence
auaguggauagaacauccag

SEQ ID NO: 3319 - RNA, 20 nt, Artificial Sequence
  spacer sequence
auaccccacuuucaauagug

SEQ ID NO: 3320 - RNA, 20 nt, Artificial Sequence
  spacer sequence
guuacuguaauuguauugcu

SEQ ID NO: 3321 - RNA, 20 nt, Artificial Sequence
  spacer sequence
gcauuugcuuuacauauuua

SEQ ID NO: 3322 - RNA, 20 nt, Artificial Sequence
  spacer sequence
gauguugagugaauauuuau

SEQ ID NO: 3323 - RNA, 20 nt, Artificial Sequence
  spacer sequence
gaacaccuaaauauguaaag

SEQ ID NO: 3324 - RNA, 20 nt, Artificial Sequence
  spacer sequence
acaucagaacaccuaaauau

SEQ ID NO: 3325 - RNA, 20 nt, Artificial Sequence
  spacer sequence
cucaacaucagaacaccuaa

SEQ ID NO: 3326 - RNA, 20 nt, Artificial Sequence
  spacer sequence
uccuagugaauuggccguuu

SEQ ID NO: 3327 - RNA, 20 nt, Artificial Sequence
  spacer sequence
uagugaauuggccguuuuau

SEQ ID NO: 3328 - RNA, 20 nt, Artificial Sequence
  spacer sequence
cuaggaagacauaacaauua

SEQ ID NO: 3329 - RNA, 20 nt, Artificial Sequence
  spacer sequence
uuauauaauguccuuccuug

SEQ ID NO: 3330 - RNA, 20 nt, Artificial Sequence
  spacer sequence
uuccuugucucuuaugacag

SEQ ID NO: 3331 - RNA, 20 nt, Artificial Sequence
  spacer sequence
uugucucuuaugacaguuuu

SEQ ID NO: 3332 - RNA, 20 nt, Artificial Sequence
  spacer sequence
cuuaugacaguuuuaaauuu

SEQ ID NO: 3333 - RNA, 20 nt, Artificial Sequence
  spacer sequence
uaugacaguuuuaaauuuua

SEQ ID NO: 3334 - RNA, 20 nt, Artificial Sequence
  spacer sequence
uaagagacaaggaaggacau

SEQ ID NO: 3335 - RNA, 20 nt, Artificial Sequence
  spacer sequence
auuuugucugauccaaguau

SEQ ID NO: 3336 - RNA, 20 nt, Artificial Sequence
  spacer sequence
gauccaaguauaaccacuuc

SEQ ID NO: 3337 - RNA, 20 nt, Artificial Sequence
  spacer sequence
gacaaaauagaguuaaaauu

SEQ ID NO: 3338 - RNA, 20 nt, Artificial Sequence
  spacer sequence
aaguauaaccacuucugcac

SEQ ID NO: 3339 - RNA, 20 nt, Artificial Sequence
  spacer sequence
gcacucguuuaccaguugca

SEQ ID NO: 3340 - RNA, 20 nt, Artificial Sequence
  spacer sequence
uguuuuuuuauccacucagc

SEQ ID NO: 3341 - RNA, 20 nt, Artificial Sequence
  spacer sequence
acucagccauucuauaucuu

SEQ ID NO: 3342 - RNA, 20 nt, Artificial Sequence
  spacer sequence
gccauucuauaucuuuugau

SEQ ID NO: 3343 - RNA, 20 nt, Artificial Sequence
  spacer sequence
auaucuuuugauuagggggu

SEQ ID NO: 3344 - RNA, 20 nt, Artificial Sequence
  spacer sequence
uuugauuaggggguuuaauc

SEQ ID NO: 3345 - RNA, 20 nt, Artificial Sequence
  spacer sequence
aaagauauagaauggcugag

SEQ ID NO: 3346 - RNA, 20 nt, Artificial Sequence
  spacer sequence
auuuacauuuaaaguaauua

SEQ ID NO: 3347 - RNA, 20 nt, Artificial Sequence
  spacer sequence
cuauaaauaauuacuuuaaa

SEQ ID NO: 3348 - RNA, 20 nt, Artificial Sequence
  spacer sequence
ucccuauaaauaauuacuuu

SEQ ID NO: 3349 - RNA, 20 nt, Artificial Sequence
  spacer sequence
ugaccucaggugaucugccu

SEQ ID NO: 3350 - RNA, 20 nt, Artificial Sequence
  spacer sequence
ggaguuugauaccagccagg

SEQ ID NO: 3351 - RNA, 20 nt, Artificial Sequence
  spacer sequence
ggugaucugccuaccuucgc

SEQ ID NO: 3352 - RNA, 20 nt, Artificial Sequence
  spacer sequence
ccugaggucaggaguuugau

SEQ ID NO: 3353 - RNA, 20 nt, Artificial Sequence
  spacer sequence
gccuaccuucgccucccaaa

SEQ ID NO: 3354 - RNA, 20 nt, Artificial Sequence
  spacer sequence
ccucccaaaguguugggauu

SEQ ID NO: 3355 - RNA, 20 nt, Artificial Sequence
  spacer sequence
caaaguguugggauuacagg

SEQ ID NO: 3356 - RNA, 20 nt, Artificial Sequence
  spacer sequence
caacacuuugggaggcgaag

SEQ ID NO: 3357 - RNA, 20 nt, Artificial Sequence
  spacer sequence
ugccuguaaucccaacacuu

SEQ ID NO: 3358 - RNA, 20 nt, Artificial Sequence
  spacer sequence
uauaauucuuuuguccaucu

SEQ ID NO: 3359 - RNA, 20 nt, Artificial Sequence
  spacer sequence
uuuguccaucuguuccucuc

SEQ ID NO: 3360 - RNA, 20 nt, Artificial Sequence
  spacer sequence
aucuguuccucucuugcugu

SEQ ID NO: 3361 - RNA, 20 nt, Artificial Sequence
  spacer sequence
guuccucucuugcugucuuc

SEQ ID NO: 3362 - RNA, 20 nt, Artificial Sequence
  spacer sequence
ucucuugcugucuuccuuuu

SEQ ID NO: 3363 - RNA, 20 nt, Artificial Sequence
  spacer sequence
cuugcugucuuccuuuuugu

SEQ ID NO: 3364 - RNA, 20 nt, Artificial Sequence
  spacer sequence
ugcugucuuccuuuuuguuu

SEQ ID NO: 3365 - RNA, 20 nt, Artificial Sequence
  spacer sequence
uccuuuuuguuuuguuuuuu

SEQ ID NO: 3366 - RNA, 20 nt, Artificial Sequence
  spacer sequence
uuuuuguuuuguuuuuuuuu

SEQ ID NO: 3367 - RNA, 20 nt, Artificial Sequence
  spacer sequence
auacaaaaaaaaaaaaaaca

SEQ ID NO: 3368 - RNA, 20 nt, Artificial Sequence
  spacer sequence
uuccucuuuuucuuuugugu

SEQ ID NO: 3369 - RNA, 20 nt, Artificial Sequence
  spacer sequence
ucuuuuucuuuuguguaauu

SEQ ID NO: 3370 - RNA, 20 nt, Artificial Sequence
  spacer sequence
uuuucuuuuguguaauuuuu

SEQ ID NO: 3371 - RNA, 20 nt, Artificial Sequence
  spacer sequence
uuuguguaauuuuuacagau

SEQ ID NO: 3372 - RNA, 20 nt, Artificial Sequence
  spacer sequence
guaaaaauuacacaaaagaa

SEQ ID NO: 3373 - RNA, 20 nt, Artificial Sequence
  spacer sequence
uugucaucaucaugggguuu

SEQ ID NO: 3374 - RNA, 20 nt, Artificial Sequence
  spacer sequence
ucaucaugggguuuacaaaa

SEQ ID NO: 3375 - RNA, 20 nt, Artificial Sequence
  spacer sequence
ucaugggguuuacaaaaaca

SEQ ID NO: 3376 - RNA, 20 nt, Artificial Sequence
  spacer sequence
ugggguuuacaaaaacaauc

SEQ ID NO: 3377 - RNA, 20 nt, Artificial Sequence
  spacer sequence
uaugguuagaacagucuauu

SEQ ID NO: 3378 - RNA, 20 nt, Artificial Sequence
  spacer sequence
aaccauaagauuguuuuugu

SEQ ID NO: 3379 - RNA, 20 nt, Artificial Sequence
  spacer sequence
auuuuaagcugauaacaacu

SEQ ID NO: 3380 - RNA, 20 nt, Artificial Sequence
  spacer sequence
gcuuaaaauagacuguucua

SEQ ID NO: 3381 - RNA, 20 nt, Artificial Sequence
  spacer sequence
auuguauacaaaacauaaua

SEQ ID NO: 3382 - RNA, 20 nt, Artificial Sequence
  spacer sequence
uaauuuacauguacuuaucu

SEQ ID NO: 3383 - RNA, 20 nt, Artificial Sequence
  spacer sequence
uauguaucuauuaauguauc

SEQ ID NO: 3384 - RNA, 20 nt, Artificial Sequence
  spacer sequence
auuaauguauccuuuaacua

SEQ ID NO: 3385 - RNA, 20 nt, Artificial Sequence
  spacer sequence
uuuaacuauagguauuuaua

SEQ ID NO: 3386 - RNA, 20 nt, Artificial Sequence
  spacer sequence
uuuaacuuuuauacuagaau

SEQ ID NO: 3387 - RNA, 20 nt, Artificial Sequence
  spacer sequence
aguauaaaaguuaaaagaca

SEQ ID NO: 3388 - RNA, 20 nt, Artificial Sequence
  spacer sequence
aaagugauuuacccacaacc

SEQ ID NO: 3389 - RNA, 20 nt, Artificial Sequence
  spacer sequence
cuuuugauucuaguauaaaa

SEQ ID NO: 3390 - RNA, 20 nt, Artificial Sequence
  spacer sequence
guauuugucuuuguauuuac

SEQ ID NO: 3391 - RNA, 20 nt, Artificial Sequence
  spacer sequence
uuguauuuaccuuuaccagu

SEQ ID NO: 3392 - RNA, 20 nt, Artificial Sequence
  spacer sequence
uaugcaacuguuuugcuguu

SEQ ID NO: 3393 - RNA, 20 nt, Artificial Sequence
  spacer sequence
uuuuguuucaacuugaagaa

SEQ ID NO: 3394 - RNA, 20 nt, Artificial Sequence
  spacer sequence
acuugaagaacucccuuuag

SEQ ID NO: 3395 - RNA, 20 nt, Artificial Sequence
  spacer sequence
aguugaaacaaaaggaugcu

SEQ ID NO: 3396 - RNA, 20 nt, Artificial Sequence
  spacer sequence
ucaaguugaaacaaaaggau

SEQ ID NO: 3397 - RNA, 20 nt, Artificial Sequence
  spacer sequence
cuuuagcauuuuuuuguacg

SEQ ID NO: 3398 - RNA, 20 nt, Artificial Sequence
  spacer sequence
uuuagcuuuuguuuuucgug

SEQ ID NO: 3399 - RNA, 20 nt, Artificial Sequence
  spacer sequence
ugggaaaacuucauuucucc

SEQ ID NO: 3400 - RNA, 20 nt, Artificial Sequence
  spacer sequence
cacgaaaaacaaaagcuaaa

SEQ ID NO: 3401 - RNA, 20 nt, Artificial Sequence
  spacer sequence
uuucuccuucauuuuggaag

SEQ ID NO: 3402 - RNA, 20 nt, Artificial Sequence
  spacer sequence
ccuucauuuuggaaggagua

SEQ ID NO: 3403 - RNA, 20 nt, Artificial Sequence
  spacer sequence
uucauuuuggaaggaguauu

SEQ ID NO: 3404 - RNA, 20 nt, Artificial Sequence
  spacer sequence
uuuuggaaggaguauuuugc

SEQ ID NO: 3405 - RNA, 20 nt, Artificial Sequence
  spacer sequence
aaaaugaaggagaaaugaag

SEQ ID NO: 3406 - RNA, 20 nt, Artificial Sequence
  spacer sequence
uuccaaaaugaaggagaaau

SEQ ID NO: 3407 - RNA, 20 nt, Artificial Sequence
  spacer sequence
uaguugacaaguuuuuuuuu

SEQ ID NO: 3408 - RNA, 20 nt, Artificial Sequence
  spacer sequence
acuaagaauacuaugccugg

SEQ ID NO: 3409 - RNA, 20 nt, Artificial Sequence
  spacer sequence
uuucaguacuuugauuauau

SEQ ID NO: 3410 - RNA, 20 nt, Artificial Sequence
  spacer sequence
guacuuugauuauauuaccc

SEQ ID NO: 3411 - RNA, 20 nt, Artificial Sequence
  spacer sequence
aaguacugaaaggaaaaaaa

SEQ ID NO: 3412 - RNA, 20 nt, Artificial Sequence
  spacer sequence
cuucuggccuacaaaguuuc

SEQ ID NO: 3413 - RNA, 20 nt, Artificial Sequence
  spacer sequence
ggccuacaaaguuuccacug

SEQ ID NO: 3414 - RNA, 20 nt, Artificial Sequence
  spacer sequence
acugagaaaucaacuuauag

SEQ ID NO: 3415 - RNA, 20 nt, Artificial Sequence
  spacer sequence
guggaaacuuuguaggccag

SEQ ID NO: 3416 - RNA, 20 nt, Artificial Sequence
  spacer sequence
caguggaaacuuuguaggcc

SEQ ID NO: 3417 - RNA, 20 nt, Artificial Sequence
  spacer sequence
acuuauagucuuauaggggc

SEQ ID NO: 3418 - RNA, 20 nt, Artificial Sequence
  spacer sequence
uauaggggcucccuuguaca

SEQ ID NO: 3419 - RNA, 20 nt, Artificial Sequence
  spacer sequence
cuuguacauguccuuauaca

SEQ ID NO: 3420 - RNA, 20 nt, Artificial Sequence
  spacer sequence
caccacugcauugaagucuu

SEQ ID NO: 3421 - RNA, 20 nt, Artificial Sequence
  spacer sequence
augaagccucgaaugccugg

SEQ ID NO: 3422 - RNA, 20 nt, Artificial Sequence
  spacer sequence
uugaacuauuaucacaccac

SEQ ID NO: 3423 - RNA, 20 nt, Artificial Sequence
  spacer sequence
aaugccugggcaaaagggau

SEQ ID NO: 3424 - RNA, 20 nt, Artificial Sequence
  spacer sequence
aggcuucauugaacuauuau

SEQ ID NO: 3425 - RNA, 20 nt, Artificial Sequence
  spacer sequence
cuuuugcccaggcauucgag

SEQ ID NO: 3426 - RNA, 20 nt, Artificial Sequence
  spacer sequence
ucccaucucagccuccagau

SEQ ID NO: 3427 - RNA, 20 nt, Artificial Sequence
  spacer sequence
caucucagccuccagauuag

SEQ ID NO: 3428 - RNA, 20 nt, Artificial Sequence
  spacer sequence
cagccuccagauuagcuggg

SEQ ID NO: 3429 - RNA, 20 nt, Artificial Sequence
  spacer sequence
gccuccagauuagcugggac

SEQ ID NO: 3430 - RNA, 20 nt, Artificial Sequence
  spacer sequence
agauuagcugggacuacagg

SEQ ID NO: 3431 - RNA, 20 nt, Artificial Sequence
  spacer sequence
ggaggcugagaugggaggau

SEQ ID NO: 3432 - RNA, 20 nt, Artificial Sequence
  spacer sequence
cagcuaaucuggaggcugag

SEQ ID NO: 3433 - RNA, 20 nt, Artificial Sequence
  spacer sequence
cgcuaauuauuuuauuuuuc

SEQ ID NO: 3434 - RNA, 20 nt, Artificial Sequence
  spacer sequence
ugccuguaauuccagcacuu

SEQ ID NO: 3435 - RNA, 20 nt, Artificial Sequence
  spacer sequence
ccacaccaggcacuucuuga

SEQ ID NO: 3436 - RNA, 20 nt, Artificial Sequence
  spacer sequence
ugaccauuuuuaaguguaua

SEQ ID NO: 3437 - RNA, 20 nt, Artificial Sequence
  spacer sequence
agaagugccuggugugguga

SEQ ID NO: 3438 - RNA, 20 nt, Artificial Sequence
  spacer sequence
guagcauuaaguauuucaua

SEQ ID NO: 3439 - RNA, 20 nt, Artificial Sequence
  spacer sequence
uauuguuguugaaccagucu

SEQ ID NO: 3440 - RNA, 20 nt, Artificial Sequence
  spacer sequence
acaacaauaugaaauacuua

SEQ ID NO: 3441 - RNA, 20 nt, Artificial Sequence
  spacer sequence
ccagacuucuuuucauccug

SEQ ID NO: 3442 - RNA, 20 nt, Artificial Sequence
  spacer sequence
agacuucuuuucauccugua

SEQ ID NO: 3443 - RNA, 20 nt, Artificial Sequence
  spacer sequence
ggagacugguucaacaacaa

SEQ ID NO: 3444 - RNA, 20 nt, Artificial Sequence
  spacer sequence
uuucauccuguaaaucuaaa

SEQ ID NO: 3445 - RNA, 20 nt, Artificial Sequence
  spacer sequence
uagcccccugcagccuugac

SEQ ID NO: 3446 - RNA, 20 nt, Artificial Sequence
  spacer sequence
aggcugcagggggcuaugac

SEQ ID NO: 3447 - RNA, 20 nt, Artificial Sequence
  spacer sequence
ugggcucaagcaauucucuu

SEQ ID NO: 3448 - RNA, 20 nt, Artificial Sequence
  spacer sequence
agcaauucucuugccucagc

SEQ ID NO: 3449 - RNA, 20 nt, Artificial Sequence
  spacer sequence
cuugccucagccucccaagu

SEQ ID NO: 3450 - RNA, 20 nt, Artificial Sequence
  spacer sequence
ugccucagccucccaaguag

SEQ ID NO: 3451 - RNA, 20 nt, Artificial Sequence
  spacer sequence
gccucccaaguagcuggaac

SEQ ID NO: 3452 - RNA, 20 nt, Artificial Sequence
  spacer sequence
caaguagcuggaacuacagg

SEQ ID NO: 3453 - RNA, 20 nt, Artificial Sequence
  spacer sequence
agcuacuugggaggcugagg

SEQ ID NO: 3454 - RNA, 20 nt, Artificial Sequence
  spacer sequence
acuaaaaauacaaaaauuag

SEQ ID NO: 3455 - RNA, 20 nt, Artificial Sequence
  spacer sequence
cuacuaaaaauacaaaaauu

SEQ ID NO: 3456 - RNA, 20 nt, Artificial Sequence
  spacer sequence
ccauguuggccaaguagguc

SEQ ID NO: 3457 - RNA, 20 nt, Artificial Sequence
  spacer sequence
agaacuccugaccucaagug

SEQ ID NO: 3458 - RNA, 20 nt, Artificial Sequence
  spacer sequence
agaccuacuuggccaacaug

SEQ ID NO: 3459 - RNA, 20 nt, Artificial Sequence
  spacer sequence
ugaccucaagugauccaccu

SEQ ID NO: 3460 - RNA, 20 nt, Artificial Sequence
  spacer sequence
ggaguucuagaccuacuugg

SEQ ID NO: 3461 - RNA, 20 nt, Artificial Sequence
  spacer sequence
agugauccaccugccucggc

SEQ ID NO: 3462 - RNA, 20 nt, Artificial Sequence
  spacer sequence
cuugaggucaggaguucuag

SEQ ID NO: 3463 - RNA, 20 nt, Artificial Sequence
  spacer sequence
accugccucggccucccaaa

SEQ ID NO: 3464 - RNA, 20 nt, Artificial Sequence
  spacer sequence
gccucccaaagugcuggacu

SEQ ID NO: 3465 - RNA, 20 nt, Artificial Sequence
  spacer sequence
caaagugcuggacuauuuug

SEQ ID NO: 3466 - RNA, 20 nt, Artificial Sequence
  spacer sequence
agcacuuugggaggccgagg

SEQ ID NO: 3467 - RNA, 20 nt, Artificial Sequence
  spacer sequence
aaaauaguccagcacuuugg

SEQ ID NO: 3468 - RNA, 20 nt, Artificial Sequence
  spacer sequence
caccuuccaaaauaguccag

SEQ ID NO: 3469 - RNA, 20 nt, Artificial Sequence
  spacer sequence
uagccaggcacgguggcuca

SEQ ID NO: 3470 - RNA, 20 nt, Artificial Sequence
  spacer sequence
auuuccuagccaggcacggu

SEQ ID NO: 3471 - RNA, 20 nt, Artificial Sequence
  spacer sequence
cacagauucauauaaggucc

SEQ ID NO: 3472 - RNA, 20 nt, Artificial Sequence
  spacer sequence
cagauucauauaagguccca

SEQ ID NO: 3473 - RNA, 20 nt, Artificial Sequence
  spacer sequence
gugagaagguaaaaaaaaaa

SEQ ID NO: 3474 - RNA, 20 nt, Artificial Sequence
  spacer sequence
uauaaggucccacucacuga

SEQ ID NO: 3475 - RNA, 20 nt, Artificial Sequence
  spacer sequence
cacucacugacauucuuuca

SEQ ID NO: 3476 - RNA, 20 nt, Artificial Sequence
  spacer sequence
cugacauucuuucaaucaca

SEQ ID NO: 3477 - RNA, 20 nt, Artificial Sequence
  spacer sequence
gugagugggaccuuauauga

SEQ ID NO: 3478 - RNA, 20 nt, Artificial Sequence
  spacer sequence
uucaaucacaucuuguuucu

SEQ ID NO: 3479 - RNA, 20 nt, Artificial Sequence
  spacer sequence
aucacaucuuguuucuggug

SEQ ID NO: 3480 - RNA, 20 nt, Artificial Sequence
  spacer sequence
caucuuguuucugguguaac

SEQ ID NO: 3481 - RNA, 20 nt, Artificial Sequence
  spacer sequence
uguuucugguguaacuauuu

SEQ ID NO: 3482 - RNA, 20 nt, Artificial Sequence
  spacer sequence
gguguaacuauuuacacuuc

SEQ ID NO: 3483 - RNA, 20 nt, Artificial Sequence
  spacer sequence
cucucucucucucuguucau

SEQ ID NO: 3484 - RNA, 20 nt, Artificial Sequence
  spacer sequence
cucucucucucuguucauaa

SEQ ID NO: 3485 - RNA, 20 nt, Artificial Sequence
  spacer sequence
cucucucucuguucauaaau

SEQ ID NO: 3486 - RNA, 20 nt, Artificial Sequence
  spacer sequence
cucucucuguucauaaauug

SEQ ID NO: 3487 - RNA, 20 nt, Artificial Sequence
  spacer sequence
cucucuguucauaaauugua

SEQ ID NO: 3488 - RNA, 20 nt, Artificial Sequence
  spacer sequence
cucuguucauaaauuguacc

SEQ ID NO: 3489 - RNA, 20 nt, Artificial Sequence
  spacer sequence
cuguucauaaauuguaccca

SEQ ID NO: 3490 - RNA, 20 nt, Artificial Sequence
  spacer sequence
guucauaaauuguacccauc

SEQ ID NO: 3491 - RNA, 20 nt, Artificial Sequence
  spacer sequence
uaaauuguacccaucacaag

SEQ ID NO: 3492 - RNA, 20 nt, Artificial Sequence
  spacer sequence
caaguaucauaaucuuauua

SEQ ID NO: 3493 - RNA, 20 nt, Artificial Sequence
  spacer sequence
uaaucuuauuaaacacuucc

SEQ ID NO: 3494 - RNA, 20 nt, Artificial Sequence
  spacer sequence
uauuaaacacuucccauacu

SEQ ID NO: 3495 - RNA, 20 nt, Artificial Sequence
  spacer sequence
cauacucacauagcuaauag

SEQ ID NO: 3496 - RNA, 20 nt, Artificial Sequence
  spacer sequence
cauagcuaauagccuuacau

SEQ ID NO: 3497 - RNA, 20 nt, Artificial Sequence
  spacer sequence
acaauguaaggcuauuagcu

SEQ ID NO: 3498 - RNA, 20 nt, Artificial Sequence
  spacer sequence
cacaaucuguugcuuuaagu

SEQ ID NO: 3499 - RNA, 20 nt, Artificial Sequence
  spacer sequence
guugcuuuaaguuuauauaa

SEQ ID NO: 3500 - RNA, 20 nt, Artificial Sequence
  spacer sequence
uuuauauaaacuuaaagcaa

SEQ ID NO: 3501 - RNA, 20 nt, Artificial Sequence
  spacer sequence
aguuccuuucaauaaaagaa

SEQ ID NO: 3502 - RNA, 20 nt, Artificial Sequence
  spacer sequence
uuucaauaaaagaacaacaa

SEQ ID NO: 3503 - RNA, 20 nt, Artificial Sequence
  spacer sequence
auaaaagaacaacaacaaua

SEQ ID NO: 3504 - RNA, 20 nt, Artificial Sequence
  spacer sequence
uuuauugaaaggaacuugau

SEQ ID NO: 3505 - RNA, 20 nt, Artificial Sequence
  spacer sequence
uuuuauuguuguuguucuuu

SEQ ID NO: 3506 - RNA, 20 nt, Artificial Sequence
  spacer sequence
uaaucuuuuuauuguuguug

SEQ ID NO: 3507 - RNA, 20 nt, Artificial Sequence
  spacer sequence
agggcuuuuuguaaggucau

SEQ ID NO: 3508 - RNA, 20 nt, Artificial Sequence
  spacer sequence
aaaauagauuaaauaaaaua

SEQ ID NO: 3509 - RNA, 20 nt, Artificial Sequence
  spacer sequence
auuuuagacauuucaagggc

SEQ ID NO: 3510 - RNA, 20 nt, Artificial Sequence
  spacer sequence
auauuuuauuuaaucuauuu

SEQ ID NO: 3511 - RNA, 20 nt, Artificial Sequence
  spacer sequence
acagggaauaagaaacagcu

SEQ ID NO: 3512 - RNA, 20 nt, Artificial Sequence
  spacer sequence
cuguugaggugcuggucuau

SEQ ID NO: 3513 - RNA, 20 nt, Artificial Sequence
  spacer sequence
uauucccuguugaggugcug

SEQ ID NO: 3514 - RNA, 20 nt, Artificial Sequence
  spacer sequence
cagacuuacacaaagccaau

SEQ ID NO: 3515 - RNA, 20 nt, Artificial Sequence
  spacer sequence
gugaaaugcuagcuguuucu

SEQ ID NO: 3516 - RNA, 20 nt, Artificial Sequence
  spacer sequence
uuggcuuuguguaagucugu

SEQ ID NO: 3517 - RNA, 20 nt, Artificial Sequence
  spacer sequence
uguguucauuggcuuugugu

SEQ ID NO: 3518 - RNA, 20 nt, Artificial Sequence
  spacer sequence
uuagcaugaauaaucaaaua

SEQ ID NO: 3519 - RNA, 20 nt, Artificial Sequence
  spacer sequence
ugcuaaugaguacauguuca

SEQ ID NO: 3520 - RNA, 20 nt, Artificial Sequence
  spacer sequence
aauaaguagaaauuuaaaau

SEQ ID NO: 3521 - RNA, 20 nt, Artificial Sequence
  spacer sequence
acuuauuugauuauucaugc

SEQ ID NO: 3522 - RNA, 20 nt, Artificial Sequence
  spacer sequence
uuuuaaauuucuacuuauuu

SEQ ID NO: 3523 - RNA, 20 nt, Artificial Sequence
  spacer sequence
uuuucaccucucagauuggu

SEQ ID NO: 3524 - RNA, 20 nt, Artificial Sequence
  spacer sequence
ccucucagauugguagguaa

SEQ ID NO: 3525 - RNA, 20 nt, Artificial Sequence
  spacer sequence
cagauugguagguaaagaga

SEQ ID NO: 3526 - RNA, 20 nt, Artificial Sequence
  spacer sequence
gauugguagguaaagagacu

SEQ ID NO: 3527 - RNA, 20 nt, Artificial Sequence
  spacer sequence
gagaggugaaaaagaaaacc

SEQ ID NO: 3528 - RNA, 20 nt, Artificial Sequence
  spacer sequence
uuaccuaccaaucugagagg

SEQ ID NO: 3529 - RNA, 20 nt, Artificial Sequence
  spacer sequence
cuuuaccuaccaaucugaga

SEQ ID NO: 3530 - RNA, 20 nt, Artificial Sequence
  spacer sequence
ccaaaccauaauaccagucu

SEQ ID NO: 3531 - RNA, 20 nt, Artificial Sequence
  spacer sequence
cuacagccucaccaaaccau

SEQ ID NO: 3532 - RNA, 20 nt, Artificial Sequence
  spacer sequence
guuuauuucccuacagccuc

SEQ ID NO: 3533 - RNA, 20 nt, Artificial Sequence
  spacer sequence
uacucuguuuauuucccuac

SEQ ID NO: 3534 - RNA, 20 nt, Artificial Sequence
  spacer sequence
auuccuacucuguuuauuuc

SEQ ID NO: 3535 - RNA, 20 nt, Artificial Sequence
  spacer sequence
uuuuauuauuuuuauauauu

SEQ ID NO: 3536 - RNA, 20 nt, Artificial Sequence
  spacer sequence
aaauauauaaaaauaauaaa

SEQ ID NO: 3537 - RNA, 20 nt, Artificial Sequence
  spacer sequence
caaaauauauaaaaauaaua

SEQ ID NO: 3538 - RNA, 20 nt, Artificial Sequence
  spacer sequence
ugucucaaaauauauaaaaa

SEQ ID NO: 3539 - RNA, 20 nt, Artificial Sequence
  spacer sequence
cacucugucucccaggcugg

SEQ ID NO: 3540 - RNA, 20 nt, Artificial Sequence
  spacer sequence
cucugucucccaggcuggag

SEQ ID NO: 3541 - RNA, 20 nt, Artificial Sequence
  spacer sequence
gucucccaggcuggagugca

SEQ ID NO: 3542 - RNA, 20 nt, Artificial Sequence
  spacer sequence
cccaggcuggagugcagugg

SEQ ID NO: 3543 - RNA, 20 nt, Artificial Sequence
  spacer sequence
caggcuggagugcaguggcg

SEQ ID NO: 3544 - RNA, 20 nt, Artificial Sequence
  spacer sequence
agccugggagacagagugag

SEQ ID NO: 3545 - RNA, 20 nt, Artificial Sequence
  spacer sequence
cgccacugcacuccagccug

SEQ ID NO: 3546 - RNA, 20 nt, Artificial Sequence
  spacer sequence
cggcucacugcaaccuccgc

SEQ ID NO: 3547 - RNA, 20 nt, Artificial Sequence
  spacer sequence
gcucacugcaaccuccgccu

SEQ ID NO: 3548 - RNA, 20 nt, Artificial Sequence
  spacer sequence
cugcaaccuccgccuccugg

SEQ ID NO: 3549 - RNA, 20 nt, Artificial Sequence
  spacer sequence
gccuccuggguucaagugac

SEQ ID NO: 3550 - RNA, 20 nt, Artificial Sequence
  spacer sequence
uggguucaagugacucuugu

SEQ ID NO: 3551 - RNA, 20 nt, Artificial Sequence
  spacer sequence
agugacucuugugccucagc

SEQ ID NO: 3552 - RNA, 20 nt, Artificial Sequence
  spacer sequence
cuugaacccaggaggcggag

SEQ ID NO: 3553 - RNA, 20 nt, Artificial Sequence
  spacer sequence
ugugccucagccucccgagu

SEQ ID NO: 3554 - RNA, 20 nt, Artificial Sequence
  spacer sequence
gccucccgaguagcugagau

SEQ ID NO: 3555 - RNA, 20 nt, Artificial Sequence
  spacer sequence
cgaguagcugagauuacagc

SEQ ID NO: 3556 - RNA, 20 nt, Artificial Sequence
  spacer sequence
ggaggcugaggcacaagagu

SEQ ID NO: 3557 - RNA, 20 nt, Artificial Sequence
  spacer sequence
gcuacucgggaggcugaggc

SEQ ID NO: 3558 - RNA, 20 nt, Artificial Sequence
  spacer sequence
cagcuacucgggaggcugag

SEQ ID NO: 3559 - RNA, 20 nt, Artificial Sequence
  spacer sequence
acuaaaaaauacaaaaauua

SEQ ID NO: 3560 - RNA, 20 nt, Artificial Sequence
  spacer sequence
cuacuaaaaaauacaaaaau

SEQ ID NO: 3561 - RNA, 20 nt, Artificial Sequence
  spacer sequence
uguuggccaggcuguaagca

SEQ ID NO: 3562 - RNA, 20 nt, Artificial Sequence
  spacer sequence
aaaugguugugcuuacagcc

SEQ ID NO: 3563 - RNA, 20 nt, Artificial Sequence
  spacer sequence
caaguuguugccaaauugug

SEQ ID NO: 3564 - RNA, 20 nt, Artificial Sequence
  spacer sequence
aaguauauaugccagcucac

SEQ ID NO: 3565 - RNA, 20 nt, Artificial Sequence
  spacer sequence
cagaagcauuccacaagucc

SEQ ID NO: 3566 - RNA, 20 nt, Artificial Sequence
  spacer sequence
gaagcauuccacaaguccau

SEQ ID NO: 3567 - RNA, 20 nt, Artificial Sequence
  spacer sequence
gagauacaaauugcucaaag

SEQ ID NO: 3568 - RNA, 20 nt, Artificial Sequence
  spacer sequence
acaaguccauaagaauauau

SEQ ID NO: 3569 - RNA, 20 nt, Artificial Sequence
  spacer sequence
auaagaauauauacaugucc

SEQ ID NO: 3570 - RNA, 20 nt, Artificial Sequence
  spacer sequence
uauggacuuguggaaugcuu

SEQ ID NO: 3571 - RNA, 20 nt, Artificial Sequence
  spacer sequence
auagaaaauacacaucuguu

SEQ ID NO: 3572 - RNA, 20 nt, Artificial Sequence
  spacer sequence
auggacauguauauauucuu

SEQ ID NO: 3573 - RNA, 20 nt, Artificial Sequence
  spacer sequence
guucuaauagcaaauaauug

SEQ ID NO: 3574 - RNA, 20 nt, Artificial Sequence
  spacer sequence
aauagcaaauaauugaaaac

SEQ ID NO: 3575 - RNA, 20 nt, Artificial Sequence
  spacer sequence
auuauuugcuauuagaacag

SEQ ID NO: 3576 - RNA, 20 nt, Artificial Sequence
  spacer sequence
acaaguccauccauaggugu

SEQ ID NO: 3577 - RNA, 20 nt, Artificial Sequence
  spacer sequence
auccauaggugugauauguu

SEQ ID NO: 3578 - RNA, 20 nt, Artificial Sequence
  spacer sequence
auaggugugauauguugaau

SEQ ID NO: 3579 - RNA, 20 nt, Artificial Sequence
  spacer sequence
caccuauggauggacuugua

SEQ ID NO: 3580 - RNA, 20 nt, Artificial Sequence
  spacer sequence
acauaucacaccuauggaug

SEQ ID NO: 3581 - RNA, 20 nt, Artificial Sequence
  spacer sequence
ccuaaaaagauaaguuuaag

SEQ ID NO: 3582 - RNA, 20 nt, Artificial Sequence
  spacer sequence
uuuuaggggacacaauucaa

SEQ ID NO: 3583 - RNA, 20 nt, Artificial Sequence
  spacer sequence
uaauccauggcauacuugcg

SEQ ID NO: 3584 - RNA, 20 nt, Artificial Sequence
  spacer sequence
auggcauacuugcgaaugug

SEQ ID NO: 3585 - RNA, 20 nt, Artificial Sequence
  spacer sequence
caaguaugccauggauuagg

SEQ ID NO: 3586 - RNA, 20 nt, Artificial Sequence
  spacer sequence
cauucgcaaguaugccaugg

SEQ ID NO: 3587 - RNA, 20 nt, Artificial Sequence
  spacer sequence
aaguaaggucacauucgcaa

SEQ ID NO: 3588 - RNA, 20 nt, Artificial Sequence
  spacer sequence
gugcagaugugauuaguuaa

SEQ ID NO: 3589 - RNA, 20 nt, Artificial Sequence
  spacer sequence
gcacagacuguauuuccaag

SEQ ID NO: 3590 - RNA, 20 nt, Artificial Sequence
  spacer sequence
caucugcacagacuguauuu

SEQ ID NO: 3591 - RNA, 20 nt, Artificial Sequence
  spacer sequence
uaacuaaucacaucugcaca

SEQ ID NO: 3592 - RNA, 20 nt, Artificial Sequence
  spacer sequence
ccaaccuuuuuugcaccagg

SEQ ID NO: 3593 - RNA, 20 nt, Artificial Sequence
  spacer sequence
cuggugcaaaaaagguuggg

SEQ ID NO: 3594 - RNA, 20 nt, Artificial Sequence
  spacer sequence
gucccuggugcaaaaaaggu

SEQ ID NO: 3595 - RNA, 20 nt, Artificial Sequence
  spacer sequence
uaucagucccuggugcaaaa

SEQ ID NO: 3596 - RNA, 20 nt, Artificial Sequence
  spacer sequence
cauaucagucccuggugcaa

SEQ ID NO: 3597 - RNA, 20 nt, Artificial Sequence
  spacer sequence
aaugcugccacugauuugac

SEQ ID NO: 3598 - RNA, 20 nt, Artificial Sequence
  spacer sequence
guggcagcauuagauucuca

SEQ ID NO: 3599 - RNA, 20 nt, Artificial Sequence
  spacer sequence
aaucaguggcagcauuagau

SEQ ID NO: 3600 - RNA, 20 nt, Artificial Sequence
  spacer sequence
ugucaaaucaguggcagcau

SEQ ID NO: 3601 - RNA, 20 nt, Artificial Sequence
  spacer sequence
gccuccugucaaaucagugg

SEQ ID NO: 3602 - RNA, 20 nt, Artificial Sequence
  spacer sequence
ggugguaauacuugucacca

SEQ ID NO: 3603 - RNA, 20 nt, Artificial Sequence
  spacer sequence
ccacucaccuccugccaugu

SEQ ID NO: 3604 - RNA, 20 nt, Artificial Sequence
  spacer sequence
ccuccugccauguggcccgg

SEQ ID NO: 3605 - RNA, 20 nt, Artificial Sequence
  spacer sequence
ugccauguggcccgguuccu

SEQ ID NO: 3606 - RNA, 20 nt, Artificial Sequence
  spacer sequence
uagcaguccacagacuggua

SEQ ID NO: 3607 - RNA, 20 nt, Artificial Sequence
  spacer sequence
acagacugguacuggucugc

SEQ ID NO: 3608 - RNA, 20 nt, Artificial Sequence
  spacer sequence
guggacugcuaggaaccggg

SEQ ID NO: 3609 - RNA, 20 nt, Artificial Sequence
  spacer sequence
gcagcccagggauuggggac

SEQ ID NO: 3610 - RNA, 20 nt, Artificial Sequence
  spacer sequence
cugggcugcagaccaguacc

SEQ ID NO: 3611 - RNA, 20 nt, Artificial Sequence
  spacer sequence
ccaaucccugggcugcagac

SEQ ID NO: 3612 - RNA, 20 nt, Artificial Sequence
  spacer sequence
aggguccccaaucccugggc

SEQ ID NO: 3613 - RNA, 20 nt, Artificial Sequence
  spacer sequence
uaacucaaggguccccaauc

SEQ ID NO: 3614 - RNA, 20 nt, Artificial Sequence
  spacer sequence
ucuuaacucaagggucccca

SEQ ID NO: 3615 - RNA, 20 nt, Artificial Sequence
  spacer sequence
auaugcccucaucuuaacuc

SEQ ID NO: 3616 - RNA, 20 nt, Artificial Sequence
  spacer sequence
gaugaguggaggaacacaag

SEQ ID NO: 3617 - RNA, 20 nt, Artificial Sequence
  spacer sequence
gagccauaucaauaugcccu

SEQ ID NO: 3618 - RNA, 20 nt, Artificial Sequence
  spacer sequence
ucggagccauaucaauaugc

SEQ ID NO: 3619 - RNA, 20 nt, Artificial Sequence
  spacer sequence
acucaucggagccauaucaa

SEQ ID NO: 3620 - RNA, 20 nt, Artificial Sequence
  spacer sequence
uccacucaucggagccauau

SEQ ID NO: 3621 - RNA, 20 nt, Artificial Sequence
  spacer sequence
ugguccucaugccgguuuag

SEQ ID NO: 3622 - RNA, 20 nt, Artificial Sequence
  spacer sequence
ucaugccgguuuagauaaaa

SEQ ID NO: 3623 - RNA, 20 nt, Artificial Sequence
  spacer sequence
ugccgguuuagauaaaacaa

SEQ ID NO: 3624 - RNA, 20 nt, Artificial Sequence
  spacer sequence
aaaccggcaugaggaccaag

SEQ ID NO: 3625 - RNA, 20 nt, Artificial Sequence
  spacer sequence
auguuguuuuaucuaaaccg

SEQ ID NO: 3626 - RNA, 20 nt, Artificial Sequence
  spacer sequence
acuuguguccauguuguuuu

SEQ ID NO: 3627 - RNA, 20 nt, Artificial Sequence
  spacer sequence
aaaaaaaaacaaaacaaaaa

SEQ ID NO: 3628 - RNA, 20 nt, Artificial Sequence
  spacer sequence
caaaaaaaaaacaaaacaaa

SEQ ID NO: 3629 - RNA, 20 nt, Artificial Sequence
  spacer sequence
gucucaaaaaaaaaacaaaa

SEQ ID NO: 3630 - RNA, 20 nt, Artificial Sequence
  spacer sequence
cgcugucgcccaggcuggag

SEQ ID NO: 3631 - RNA, 20 nt, Artificial Sequence
  spacer sequence
cugucgcccaggcuggagug

SEQ ID NO: 3632 - RNA, 20 nt, Artificial Sequence
  spacer sequence
cccaggcuggagugcagugg

SEQ ID NO: 3633 - RNA, 20 nt, Artificial Sequence
  spacer sequence
agccugggcgacagcgagac

SEQ ID NO: 3634 - RNA, 20 nt, Artificial Sequence
  spacer sequence
cggcucacugcaggcuccgc

SEQ ID NO: 3635 - RNA, 20 nt, Artificial Sequence
  spacer sequence
gcucacugcaggcuccgccc

SEQ ID NO: 3636 - RNA, 20 nt, Artificial Sequence
  spacer sequence
cugcaggcuccgcccccugg

SEQ ID NO: 3637 - RNA, 20 nt, Artificial Sequence
  spacer sequence
gcccccugggguucacgcca

SEQ ID NO: 3638 - RNA, 20 nt, Artificial Sequence
  spacer sequence
cgccauucuccugccucagc

SEQ ID NO: 3639 - RNA, 20 nt, Artificial Sequence
  spacer sequence
ccugccucagccucccgagu

SEQ ID NO: 3640 - RNA, 20 nt, Artificial Sequence
  spacer sequence
ugccucagccucccgaguag

SEQ ID NO: 3641 - RNA, 20 nt, Artificial Sequence
  spacer sequence
gccucccgaguagcugggac

SEQ ID NO: 3642 - RNA, 20 nt, Artificial Sequence
  spacer sequence
cgaguagcugggacuacagg

SEQ ID NO: 3643 - RNA, 20 nt, Artificial Sequence
  spacer sequence
ggaggcugaggcaggagaau

SEQ ID NO: 3644 - RNA, 20 nt, Artificial Sequence
  spacer sequence
cagcuacucgggaggcugag

SEQ ID NO: 3645 - RNA, 20 nt, Artificial Sequence
  spacer sequence
cccggcuaauuuuuuguauu

SEQ ID NO: 3646 - RNA, 20 nt, Artificial Sequence
  spacer sequence
acuaaaaauacaaaaaauua

SEQ ID NO: 3647 - RNA, 20 nt, Artificial Sequence
  spacer sequence
cuacuaaaaauacaaaaaau

SEQ ID NO: 3648 - RNA, 20 nt, Artificial Sequence
  spacer sequence
ccguguuagccaggaugguc

SEQ ID NO: 3649 - RNA, 20 nt, Artificial Sequence
  spacer sequence
uggcuaacacggugaaaccc

SEQ ID NO: 3650 - RNA, 20 nt, Artificial Sequence
  spacer sequence
cgaucuccugaccucgugau

SEQ ID NO: 3651 - RNA, 20 nt, Artificial Sequence
  spacer sequence
aucuccugaccucgugaucc

SEQ ID NO: 3652 - RNA, 20 nt, Artificial Sequence
  spacer sequence
agaccauccuggcuaacacg

SEQ ID NO: 3653 - RNA, 20 nt, Artificial Sequence
  spacer sequence
ccugaccucgugauccgccc

SEQ ID NO: 3654 - RNA, 20 nt, Artificial Sequence
  spacer sequence
ugaccucgugauccgcccgc

SEQ ID NO: 3655 - RNA, 20 nt, Artificial Sequence
  spacer sequence
ggagaucgagaccauccugg

SEQ ID NO: 3656 - RNA, 20 nt, Artificial Sequence
  spacer sequence
ugauccgcccgccucggccu

SEQ ID NO: 3657 - RNA, 20 nt, Artificial Sequence
  spacer sequence
cgaggucaggagaucgagac

SEQ ID NO: 3658 - RNA, 20 nt, Artificial Sequence
  spacer sequence
gcccgccucggccucccaaa

SEQ ID NO: 3659 - RNA, 20 nt, Artificial Sequence
  spacer sequence
gccucccaaagugcugggau

SEQ ID NO: 3660 - RNA, 20 nt, Artificial Sequence
  spacer sequence
caaagugcugggauuacagg

SEQ ID NO: 3661 - RNA, 20 nt, Artificial Sequence
  spacer sequence
cagcacuuugggaggccgag

SEQ ID NO: 3662 - RNA, 20 nt, Artificial Sequence
  spacer sequence
cgccuguaaucccagcacuu

SEQ ID NO: 3663 - RNA, 20 nt, Artificial Sequence
  spacer sequence
acggccgggcgcgguggcuc

SEQ ID NO: 3664 - RNA, 20 nt, Artificial Sequence
  spacer sequence
ugccuauuaaacuugccuau

SEQ ID NO: 3665 - RNA, 20 nt, Artificial Sequence
  spacer sequence
cuucuugccuauuaaacuug

SEQ ID NO: 3666 - RNA, 20 nt, Artificial Sequence
  spacer sequence
cccuucuugccuauuaaacu

SEQ ID NO: 3667 - RNA, 20 nt, Artificial Sequence
  spacer sequence
gccuucucccuucuugccua

SEQ ID NO: 3668 - RNA, 20 nt, Artificial Sequence
  spacer sequence
uucugccuucucccuucuug

SEQ ID NO: 3669 - RNA, 20 nt, Artificial Sequence
  spacer sequence
uccuucugccuucucccuuc

SEQ ID NO: 3670 - RNA, 20 nt, Artificial Sequence
  spacer sequence
cucguacagagacaagaggc

SEQ ID NO: 3671 - RNA, 20 nt, Artificial Sequence
  spacer sequence
uacagagacaagaggcagag

SEQ ID NO: 3672 - RNA, 20 nt, Artificial Sequence
  spacer sequence
guacgagggagcuucuuccu

SEQ ID NO: 3673 - RNA, 20 nt, Artificial Sequence
  spacer sequence
cuguacgagggagcuucuuc

SEQ ID NO: 3674 - RNA, 20 nt, Artificial Sequence
  spacer sequence
ugucucuguacgagggagcu

SEQ ID NO: 3675 - RNA, 20 nt, Artificial Sequence
  spacer sequence
gccucuugucucuguacgag

SEQ ID NO: 3676 - RNA, 20 nt, Artificial Sequence
  spacer sequence
cugccucuugucucuguacg

SEQ ID NO: 3677 - RNA, 20 nt, Artificial Sequence
  spacer sequence
aaagccgaaagaguagacac

SEQ ID NO: 3678 - RNA, 20 nt, Artificial Sequence
  spacer sequence
gcuuuggagccucucugccu

SEQ ID NO: 3679 - RNA, 20 nt, Artificial Sequence
  spacer sequence
uucggcuuuggagccucucu

SEQ ID NO: 3680 - RNA, 20 nt, Artificial Sequence
  spacer sequence
acucuuucggcuuuggagcc

SEQ ID NO: 3681 - RNA, 20 nt, Artificial Sequence
  spacer sequence
acuuggugucuacucuuucg

SEQ ID NO: 3682 - RNA, 20 nt, Artificial Sequence
  spacer sequence
cuccacuuggugucuacucu

SEQ ID NO: 3683 - RNA, 20 nt, Artificial Sequence
  spacer sequence
auauaaacuuagcugguuuu

SEQ ID NO: 3684 - RNA, 20 nt, Artificial Sequence
  spacer sequence
agccucuauauaaacuuagc

SEQ ID NO: 3685 - RNA, 20 nt, Artificial Sequence
  spacer sequence
uccagccucuauauaaacuu

SEQ ID NO: 3686 - RNA, 20 nt, Artificial Sequence
  spacer sequence
gauuugcacagggcucaggg

SEQ ID NO: 3687 - RNA, 20 nt, Artificial Sequence
  spacer sequence
gacaccgccuccuccagccu

SEQ ID NO: 3688 - RNA, 20 nt, Artificial Sequence
  spacer sequence
ggggauugguuugaccaggc

SEQ ID NO: 3689 - RNA, 20 nt, Artificial Sequence
  spacer sequence
ccugagcccugugcaaauca

SEQ ID NO: 3690 - RNA, 20 nt, Artificial Sequence
  spacer sequence
aaccaauccccugagcccug

SEQ ID NO: 3691 - RNA, 20 nt, Artificial Sequence
  spacer sequence
uucacgcagcccgggaaaaa

SEQ ID NO: 3692 - RNA, 20 nt, Artificial Sequence
  spacer sequence
cgcagcccgggaaaaagcug

SEQ ID NO: 3693 - RNA, 20 nt, Artificial Sequence
  spacer sequence
cgggcugcgugaaugacaug

SEQ ID NO: 3694 - RNA, 20 nt, Artificial Sequence
  spacer sequence
acccacccuagccuuuuaau

SEQ ID NO: 3695 - RNA, 20 nt, Artificial Sequence
  spacer sequence
gcauuugcauauuaaaaggc

SEQ ID NO: 3696 - RNA, 20 nt, Artificial Sequence
  spacer sequence
uggugcucugcauuugcaua

SEQ ID NO: 3697 - RNA, 20 nt, Artificial Sequence
  spacer sequence
acacacguggggauacgugg

SEQ ID NO: 3698 - RNA, 20 nt, Artificial Sequence
  spacer sequence
ccacguguguagaacaucau

SEQ ID NO: 3699 - RNA, 20 nt, Artificial Sequence
  spacer sequence
ugcccuugccccacaagugc

SEQ ID NO: 3700 - RNA, 20 nt, Artificial Sequence
  spacer sequence
ucuugcccuugccccacaag

SEQ ID NO: 3701 - RNA, 20 nt, Artificial Sequence
  spacer sequence
ucuucuugcccuugccccac

SEQ ID NO: 3702 - RNA, 20 nt, Artificial Sequence
  spacer sequence
cacccucuucuucuugcccu

SEQ ID NO: 3703 - RNA, 20 nt, Artificial Sequence
  spacer sequence
uguuuggguagacccaguuu

SEQ ID NO: 3704 - RNA, 20 nt, Artificial Sequence
  spacer sequence
acccaaacaugacaauuccc

SEQ ID NO: 3705 - RNA, 20 nt, Artificial Sequence
  spacer sequence
aauggccagcaugugcauau

SEQ ID NO: 3706 - RNA, 20 nt, Artificial Sequence
  spacer sequence
aagguugcuggccuggcucu

SEQ ID NO: 3707 - RNA, 20 nt, Artificial Sequence
  spacer sequence
aagagccugggcuugacaag

SEQ ID NO: 3708 - RNA, 20 nt, Artificial Sequence
  spacer sequence
uagagccaggccagcaaccu

SEQ ID NO: 3709 - RNA, 20 nt, Artificial Sequence
  spacer sequence
agcccaggcucuuagagcca

SEQ ID NO: 3710 - RNA, 20 nt, Artificial Sequence
  spacer sequence
ugucaagcccaggcucuuag

SEQ ID NO: 3711 - RNA, 20 nt, Artificial Sequence
  spacer sequence
ggaacagcuuuaaaaaugaa

SEQ ID NO: 3712 - RNA, 20 nt, Artificial Sequence
  spacer sequence
agaaagguuucuugucaagc

SEQ ID NO: 3713 - RNA, 20 nt, Artificial Sequence
  spacer sequence
uuuuuaaagcuguuccagaa

SEQ ID NO: 3714 - RNA, 20 nt, Artificial Sequence
  spacer sequence
caaggaccccuuuuccucuc

SEQ ID NO: 3715 - RNA, 20 nt, Artificial Sequence
  spacer sequence
uugggaaguuuucauuuuua

SEQ ID NO: 3716 - RNA, 20 nt, Artificial Sequence
  spacer sequence
ucucuaucugccuaaaauaa

SEQ ID NO: 3717 - RNA, 20 nt, Artificial Sequence
  spacer sequence
cuaucugccuaaaauaauuu

SEQ ID NO: 3718 - RNA, 20 nt, Artificial Sequence
  spacer sequence
aucugccuaaaauaauuucu

SEQ ID NO: 3719 - RNA, 20 nt, Artificial Sequence
  spacer sequence
gccuaaaauaauuucuuaau

SEQ ID NO: 3720 - RNA, 20 nt, Artificial Sequence
  spacer sequence
uaauaacuccuaccacaaua

SEQ ID NO: 3721 - RNA, 20 nt, Artificial Sequence
  spacer sequence
uaccacaauacgggauuaga

SEQ ID NO: 3722 - RNA, 20 nt, Artificial Sequence
  spacer sequence
cguauugugguaggaguuau

SEQ ID NO: 3723 - RNA, 20 nt, Artificial Sequence
  spacer sequence
aaucccguauugugguagga

SEQ ID NO: 3724 - RNA, 20 nt, Artificial Sequence
  spacer sequence
acucuaaucccguauugugg

SEQ ID NO: 3725 - RNA, 20 nt, Artificial Sequence
  spacer sequence
uaaacccaaugauggguguc

SEQ ID NO: 3726 - RNA, 20 nt, Artificial Sequence
  spacer sequence
uuggguuuaggaucaacucu

SEQ ID NO: 3727 - RNA, 20 nt, Artificial Sequence
  spacer sequence
uuggaagaagaggagaggac

SEQ ID NO: 3728 - RNA, 20 nt, Artificial Sequence
  spacer sequence
aaggacacccaucauugggu

SEQ ID NO: 3729 - RNA, 20 nt, Artificial Sequence
  spacer sequence
uccaaggacacccaucauug

SEQ ID NO: 3730 - RNA, 20 nt, Artificial Sequence
  spacer sequence
ucuuccaaggacacccauca

SEQ ID NO: 3731 - RNA, 20 nt, Artificial Sequence
  spacer sequence
ucuucuuccaaggacaccca

SEQ ID NO: 3732 - RNA, 20 nt, Artificial Sequence
  spacer sequence
ccucuucuuccaaggacacc

SEQ ID NO: 3733 - RNA, 20 nt, Artificial Sequence
  spacer sequence
ucuccucuucuuccaaggac

SEQ ID NO: 3734 - RNA, 20 nt, Artificial Sequence
  spacer sequence
guguguccucuccucuucuu

SEQ ID NO: 3735 - RNA, 20 nt, Artificial Sequence
  spacer sequence
uguuucuguguguccucucc

SEQ ID NO: 3736 - RNA, 20 nt, Artificial Sequence
  spacer sequence
auaugugucuuguuucugug

SEQ ID NO: 3737 - RNA, 20 nt, Artificial Sequence
  spacer sequence
cuauaugugucuuguuucug

SEQ ID NO: 3738 - RNA, 20 nt, Artificial Sequence
  spacer sequence
ucucuauaugugucuuguuu

SEQ ID NO: 3739 - RNA, 20 nt, Artificial Sequence
  spacer sequence
uccucucuauaugugucuug

SEQ ID NO: 3740 - RNA, 20 nt, Artificial Sequence
  spacer sequence
cauggucuuccucucuauau

SEQ ID NO: 3741 - RNA, 20 nt, Artificial Sequence
  spacer sequence
gccaauguggucacaugguc

SEQ ID NO: 3742 - RNA, 20 nt, Artificial Sequence
  spacer sequence
cugccaauguggucacaugg

SEQ ID NO: 3743 - RNA, 20 nt, Artificial Sequence
  spacer sequence
caccaaucucugccaaugug

SEQ ID NO: 3744 - RNA, 20 nt, Artificial Sequence
  spacer sequence
uuggcuuauggccccaucac

SEQ ID NO: 3745 - RNA, 20 nt, Artificial Sequence
  spacer sequence
ugguguucguuggcuuaugg

SEQ ID NO: 3746 - RNA, 20 nt, Artificial Sequence
  spacer sequence
gguggcuccugguguucguu

SEQ ID NO: 3747 - RNA, 20 nt, Artificial Sequence
  spacer sequence
agcuucugguggcuccuggu

SEQ ID NO: 3748 - RNA, 20 nt, Artificial Sequence
  spacer sequence
ucuagcuucugguggcuccu

SEQ ID NO: 3749 - RNA, 20 nt, Artificial Sequence
  spacer sequence
cuugccucuucuagcuucug

SEQ ID NO: 3750 - RNA, 20 nt, Artificial Sequence
  spacer sequence
ucccuugccucuucuagcuu

SEQ ID NO: 3751 - RNA, 20 nt, Artificial Sequence
  spacer sequence
uuucuagagcuguuagagag

SEQ ID NO: 3752 - RNA, 20 nt, Artificial Sequence
  spacer sequence
agagcuguuagagagacugc

SEQ ID NO: 3753 - RNA, 20 nt, Artificial Sequence
  spacer sequence
agaaaugaauccucccuugc

SEQ ID NO: 3754 - RNA, 20 nt, Artificial Sequence
  spacer sequence
aacagcucuagaaaugaauc

SEQ ID NO: 3755 - RNA, 20 nt, Artificial Sequence
  spacer sequence
cuaacagcucuagaaaugaa

SEQ ID NO: 3756 - RNA, 20 nt, Artificial Sequence
  spacer sequence
cucuaacagcucuagaaaug

SEQ ID NO: 3757 - RNA, 20 nt, Artificial Sequence
  spacer sequence
guggggcugcagucucucua

SEQ ID NO: 3758 - RNA, 20 nt, Artificial Sequence
  spacer sequence
caguggggcugcagucucuc

SEQ ID NO: 3759 - RNA, 20 nt, Artificial Sequence
  spacer sequence
aggucucaguggggcugcag

SEQ ID NO: 3760 - RNA, 20 nt, Artificial Sequence
  spacer sequence
gcccucuagaacugugggaa

SEQ ID NO: 3761 - RNA, 20 nt, Artificial Sequence
  spacer sequence
agaacugugggaaaauaaau

SEQ ID NO: 3762 - RNA, 20 nt, Artificial Sequence
  spacer sequence
agagggcggauuugcaaaau

SEQ ID NO: 3763 - RNA, 20 nt, Artificial Sequence
  spacer sequence
cacaguucuagagggcggau

SEQ ID NO: 3764 - RNA, 20 nt, Artificial Sequence
  spacer sequence
guuguuuuaagccacccaau

SEQ ID NO: 3765 - RNA, 20 nt, Artificial Sequence
  spacer sequence
auaaauagugguacaggcca

SEQ ID NO: 3766 - RNA, 20 nt, Artificial Sequence
  spacer sequence
caccuguaaucucagcacuu

SEQ ID NO: 3767 - RNA, 20 nt, Artificial Sequence
  spacer sequence
cagcacuuugggaggccgag

SEQ ID NO: 3768 - RNA, 20 nt, Artificial Sequence
  spacer sequence
gcacuuugggaggccgaggu

SEQ ID NO: 3769 - RNA, 20 nt, Artificial Sequence
  spacer sequence
caaagugcugagauuacagg

SEQ ID NO: 3770 - RNA, 20 nt, Artificial Sequence
  spacer sequence
gccucccaaagugcugagau

SEQ ID NO: 3771 - RNA, 20 nt, Artificial Sequence
  spacer sequence
acccaccucggccucccaaa

SEQ ID NO: 3772 - RNA, 20 nt, Artificial Sequence
  spacer sequence
agcaguccacccaccucggc

SEQ ID NO: 3773 - RNA, 20 nt, Artificial Sequence
  spacer sequence
ugccucaagcaguccaccca

SEQ ID NO: 3774 - RNA, 20 nt, Artificial Sequence
  spacer sequence
agaccagccugcccaaugug

SEQ ID NO: 3775 - RNA, 20 nt, Artificial Sequence
  spacer sequence
aacuccugccucaagcaguc

SEQ ID NO: 3776 - RNA, 20 nt, Artificial Sequence
  spacer sequence
cgaacuccugccucaagcag

SEQ ID NO: 3777 - RNA, 20 nt, Artificial Sequence
  spacer sequence
ccacauugggcaggcugguc

SEQ ID NO: 3778 - RNA, 20 nt, Artificial Sequence
  spacer sequence
ucucuacuaaaaauacaaaa

SEQ ID NO: 3779 - RNA, 20 nt, Artificial Sequence
  spacer sequence
cuacuaaaaauacaaaaauu

SEQ ID NO: 3780 - RNA, 20 nt, Artificial Sequence
  spacer sequence
acuaaaaauacaaaaauuag

SEQ ID NO: 3781 - RNA, 20 nt, Artificial Sequence
  spacer sequence
cagcuacucuggagacugag

SEQ ID NO: 3782 - RNA, 20 nt, Artificial Sequence
  spacer sequence
ggagacugaggcaggagaau

SEQ ID NO: 3783 - RNA, 20 nt, Artificial Sequence
  spacer sequence
agaguagcugggacuacagg

SEQ ID NO: 3784 - RNA, 20 nt, Artificial Sequence
  spacer sequence
ccagaguagcugggacuaca

SEQ ID NO: 3785 - RNA, 20 nt, Artificial Sequence
  spacer sequence
gucuccagaguagcugggac

SEQ ID NO: 3786 - RNA, 20 nt, Artificial Sequence
  spacer sequence
ugccucagucuccagaguag

SEQ ID NO: 3787 - RNA, 20 nt, Artificial Sequence
  spacer sequence
ccugccucagucuccagagu

SEQ ID NO: 3788 - RNA, 20 nt, Artificial Sequence
  spacer sequence
cuugaacccagguggagguu

SEQ ID NO: 3789 - RNA, 20 nt, Artificial Sequence
  spacer sequence
agcgauucuccugccucagu

SEQ ID NO: 3790 - RNA, 20 nt, Artificial Sequence
  spacer sequence
accuggguucaagcgauucu

SEQ ID NO: 3791 - RNA, 20 nt, Artificial Sequence
  spacer sequence
cugcaaccuccaccuggguu

SEQ ID NO: 3792 - RNA, 20 nt, Artificial Sequence
  spacer sequence
uggcucacugcaaccuccac

SEQ ID NO: 3793 - RNA, 20 nt, Artificial Sequence
  spacer sequence
agccuggacgacagugagac

SEQ ID NO: 3794 - RNA, 20 nt, Artificial Sequence
  spacer sequence
aggcuggagcacaguggcac

SEQ ID NO: 3795 - RNA, 20 nt, Artificial Sequence
  spacer sequence
uccaggcuggagcacagugg

SEQ ID NO: 3796 - RNA, 20 nt, Artificial Sequence
  spacer sequence
cugucguccaggcuggagca

SEQ ID NO: 3797 - RNA, 20 nt, Artificial Sequence
  spacer sequence
cacugucguccaggcuggag

SEQ ID NO: 3798 - RNA, 20 nt, Artificial Sequence
  spacer sequence
gucucaaauaaauaaauaaa

SEQ ID NO: 3799 - RNA, 20 nt, Artificial Sequence
  spacer sequence
caaauaaauaaauaaauaaa

SEQ ID NO: 3800 - RNA, 20 nt, Artificial Sequence
  spacer sequence
aauaaauaaauaaauaaaua

SEQ ID NO: 3801 - RNA, 20 nt, Artificial Sequence
  spacer sequence
cguguauguaccacuauuua

SEQ ID NO: 3802 - RNA, 20 nt, Artificial Sequence
  spacer sequence
uuagucacguguauguacca

SEQ ID NO: 3803 - RNA, 20 nt, Artificial Sequence
  spacer sequence
aucuuuagucacguguaugu

SEQ ID NO: 3804 - RNA, 20 nt, Artificial Sequence
  spacer sequence
cuuccaucuuuagucacgug

SEQ ID NO: 3805 - RNA, 20 nt, Artificial Sequence
  spacer sequence
caucuauucccuuuuuuucg

SEQ ID NO: 3806 - RNA, 20 nt, Artificial Sequence
  spacer sequence
auucccuuuuuuucguuuuu

SEQ ID NO: 3807 - RNA, 20 nt, Artificial Sequence
  spacer sequence
cuuuuuuucguuuuuuuuuu

SEQ ID NO: 3808 - RNA, 20 nt, Artificial Sequence
  spacer sequence
uuuuuuuuuuugagacgcag

SEQ ID NO: 3809 - RNA, 20 nt, Artificial Sequence
  spacer sequence
aaaaaaaaaacgaaaaaaag

SEQ ID NO: 3810 - RNA, 20 nt, Artificial Sequence
  spacer sequence
caaaaaaaaaaacgaaaaaa

SEQ ID NO: 3811 - RNA, 20 nt, Artificial Sequence
  spacer sequence
uugcccuguugcucaggcug

SEQ ID NO: 3812 - RNA, 20 nt, Artificial Sequence
  spacer sequence
ggcuggaguccaguggugca

SEQ ID NO: 3813 - RNA, 20 nt, Artificial Sequence
  spacer sequence
agccugagcaacagggcaaa

SEQ ID NO: 3814 - RNA, 20 nt, Artificial Sequence
  spacer sequence
aguggugcaaucucggcuca

SEQ ID NO: 3815 - RNA, 20 nt, Artificial Sequence
  spacer sequence
cggcucaccucugcuuccug

SEQ ID NO: 3816 - RNA, 20 nt, Artificial Sequence
  spacer sequence
gcucaccucugcuuccuggg

SEQ ID NO: 3817 - RNA, 20 nt, Artificial Sequence
  spacer sequence
ccucugcuuccuggguuccg

SEQ ID NO: 3818 - RNA, 20 nt, Artificial Sequence
  spacer sequence
gcuuccuggguuccggagau

SEQ ID NO: 3819 - RNA, 20 nt, Artificial Sequence
  spacer sequence
uggguuccggagauucuccu

SEQ ID NO: 3820 - RNA, 20 nt, Artificial Sequence
  spacer sequence
ggagauucuccugccucaga

SEQ ID NO: 3821 - RNA, 20 nt, Artificial Sequence
  spacer sequence
ggaacccaggaagcagaggu

SEQ ID NO: 3822 - RNA, 20 nt, Artificial Sequence
  spacer sequence
ccggaacccaggaagcagag

SEQ ID NO: 3823 - RNA, 20 nt, Artificial Sequence
  spacer sequence
ccugccucagacuccaagua

SEQ ID NO: 3824 - RNA, 20 nt, Artificial Sequence
  spacer sequence
ugccucagacuccaaguagu

SEQ ID NO: 3825 - RNA, 20 nt, Artificial Sequence
  spacer sequence
gacuccaaguaguuggaauu

SEQ ID NO: 3826 - RNA, 20 nt, Artificial Sequence
  spacer sequence
gaggcaggagaaucuccgga

SEQ ID NO: 3827 - RNA, 20 nt, Artificial Sequence
  spacer sequence
aaguaguuggaauuacaagc

SEQ ID NO: 3828 - RNA, 20 nt, Artificial Sequence
  spacer sequence
aacuacuuggagucugaggc

SEQ ID NO: 3829 - RNA, 20 nt, Artificial Sequence
  spacer sequence
gccuggcguggugugggcuu

SEQ ID NO: 3830 - RNA, 20 nt, Artificial Sequence
  spacer sequence
aguaaaaauacaaaaaucag

SEQ ID NO: 3831 - RNA, 20 nt, Artificial Sequence
  spacer sequence
cuaguaaaaauacaaaaauc

SEQ ID NO: 3832 - RNA, 20 nt, Artificial Sequence
  spacer sequence
cuauguuggccaggcugguc

SEQ ID NO: 3833 - RNA, 20 nt, Artificial Sequence
  spacer sequence
caaacuccugaccucgggug

SEQ ID NO: 3834 - RNA, 20 nt, Artificial Sequence
  spacer sequence
aacuccugaccucgggugau

SEQ ID NO: 3835 - RNA, 20 nt, Artificial Sequence
  spacer sequence
ugaccucgggugauccgcuc

SEQ ID NO: 3836 - RNA, 20 nt, Artificial Sequence
  spacer sequence
ggaguuugagaccagccugg

SEQ ID NO: 3837 - RNA, 20 nt, Artificial Sequence
  spacer sequence
ggugauccgcucaccuuggc

SEQ ID NO: 3838 - RNA, 20 nt, Artificial Sequence
  spacer sequence
cccgaggucaggaguuugag

SEQ ID NO: 3839 - RNA, 20 nt, Artificial Sequence
  spacer sequence
gcucaccuuggccucccaga

SEQ ID NO: 3840 - RNA, 20 nt, Artificial Sequence
  spacer sequence
ccuuggccucccagagugcu

SEQ ID NO: 3841 - RNA, 20 nt, Artificial Sequence
  spacer sequence
cagagugcugggauuacagg

SEQ ID NO: 3842 - RNA, 20 nt, Artificial Sequence
  spacer sequence
gggaggccaaggugagcgga

SEQ ID NO: 3843 - RNA, 20 nt, Artificial Sequence
  spacer sequence
cagcacucugggaggccaag

SEQ ID NO: 3844 - RNA, 20 nt, Artificial Sequence
  spacer sequence
ugccuguaaucccagcacuc

SEQ ID NO: 3845 - RNA, 20 nt, Artificial Sequence
  spacer sequence
cuuuuauguuuugguuucug

SEQ ID NO: 3846 - RNA, 20 nt, Artificial Sequence
  spacer sequence
uuuauguuuugguuucugaa

SEQ ID NO: 3847 - RNA, 20 nt, Artificial Sequence
  spacer sequence
gaacuaugugaaaauaauuu

SEQ ID NO: 3848 - RNA, 20 nt, Artificial Sequence
  spacer sequence
gaaaccaaaacauaaaagag

SEQ ID NO: 3849 - RNA, 20 nt, Artificial Sequence
  spacer sequence
cauaguucagaaaccaaaac

SEQ ID NO: 3850 - RNA, 20 nt, Artificial Sequence
  spacer sequence
ugaaaauaaaguacaauuua

SEQ ID NO: 3851 - RNA, 20 nt, Artificial Sequence
  spacer sequence
ugaaauaaauuauuuucaca

SEQ ID NO: 3852 - RNA, 20 nt, Artificial Sequence
  spacer sequence
ugccuguaauccuagcacuu

SEQ ID NO: 3853 - RNA, 20 nt, Artificial Sequence
  spacer sequence
uagcacuuugggaggcggag

SEQ ID NO: 3854 - RNA, 20 nt, Artificial Sequence
  spacer sequence
caaagugcuaggauuacagg

SEQ ID NO: 3855 - RNA, 20 nt, Artificial Sequence
  spacer sequence
gccucccaaagugcuaggau

SEQ ID NO: 3856 - RNA, 20 nt, Artificial Sequence
  spacer sequence
ugccuccgccucccaaagug

SEQ ID NO: 3857 - RNA, 20 nt, Artificial Sequence
  spacer sequence
gggguuugauaccagccugg

SEQ ID NO: 3858 - RNA, 20 nt, Artificial Sequence
  spacer sequence
aaccccugagcuuaagcaau

SEQ ID NO: 3859 - RNA, 20 nt, Artificial Sequence
  spacer sequence
ugaaaccccaucucuacaaa

SEQ ID NO: 3860 - RNA, 20 nt, Artificial Sequence
  spacer sequence
cgauguugcccaggcuggua

SEQ ID NO: 3861 - RNA, 20 nt, Artificial Sequence
  spacer sequence
cuacaaaaacuagccaggca

SEQ ID NO: 3862 - RNA, 20 nt, Artificial Sequence
  spacer sequence
acaaaaacuagccaggcaug

SEQ ID NO: 3863 - RNA, 20 nt, Artificial Sequence
  spacer sequence
guagucucagcugcucagga

SEQ ID NO: 3864 - RNA, 20 nt, Artificial Sequence
  spacer sequence
cagcugcucaggaggcugaa

SEQ ID NO: 3865 - RNA, 20 nt, Artificial Sequence
  spacer sequence
gcugcucaggaggcugaaca

SEQ ID NO: 3866 - RNA, 20 nt, Artificial Sequence
  spacer sequence
ggaggcugaacagguaggau

SEQ ID NO: 3867 - RNA, 20 nt, Artificial Sequence
  spacer sequence
ugagcagcugagacuacaga

SEQ ID NO: 3868 - RNA, 20 nt, Artificial Sequence
  spacer sequence
gccuccugagcagcugagac

SEQ ID NO: 3869 - RNA, 20 nt, Artificial Sequence
  spacer sequence
uaccuguucagccuccugag

SEQ ID NO: 3870 - RNA, 20 nt, Artificial Sequence
  spacer sequence
agcaauccuaccuguucagc

SEQ ID NO: 3871 - RNA, 20 nt, Artificial Sequence
  spacer sequence
ggcucaagcaauccuaccug

SEQ ID NO: 3872 - RNA, 20 nt, Artificial Sequence
  spacer sequence
caggcucaagcaauccuacc

SEQ ID NO: 3873 - RNA, 20 nt, Artificial Sequence
  spacer sequence
uugcaaccccagccucucag

SEQ ID NO: 3874 - RNA, 20 nt, Artificial Sequence
  spacer sequence
cacucauugcaaccccagcc

SEQ ID NO: 3875 - RNA, 20 nt, Artificial Sequence
  spacer sequence
ugccacuguacuccagcuug

SEQ ID NO: 3876 - RNA, 20 nt, Artificial Sequence
  spacer sequence
agcuugggggacagagugag

SEQ ID NO: 3877 - RNA, 20 nt, Artificial Sequence
  spacer sequence
cccaagcuggaguacagugg

SEQ ID NO: 3878 - RNA, 20 nt, Artificial Sequence
  spacer sequence
gucccccaagcuggaguaca

SEQ ID NO: 3879 - RNA, 20 nt, Artificial Sequence
  spacer sequence
cucugucccccaagcuggag

SEQ ID NO: 3880 - RNA, 20 nt, Artificial Sequence
  spacer sequence
cacucugucccccaagcugg

SEQ ID NO: 3881 - RNA, 20 nt, Artificial Sequence
  spacer sequence
caaaaaauaaauaaguaaau

SEQ ID NO: 3882 - RNA, 20 nt, Artificial Sequence
  spacer sequence
aaaaauaaauaaguaaauau

SEQ ID NO: 3883 - RNA, 20 nt, Artificial Sequence
  spacer sequence
cgccuguaaucccagcaguu

SEQ ID NO: 3884 - RNA, 20 nt, Artificial Sequence
  spacer sequence
cagcaguuugugaagcugag

SEQ ID NO: 3885 - RNA, 20 nt, Artificial Sequence
  spacer sequence
caaacugcugggauuacagg

SEQ ID NO: 3886 - RNA, 20 nt, Artificial Sequence
  spacer sequence
gcuucacaaacugcugggau

SEQ ID NO: 3887 - RNA, 20 nt, Artificial Sequence
  spacer sequence
gccuggcucagcuucacaaa

SEQ ID NO: 3888 - RNA, 20 nt, Artificial Sequence
  spacer sequence
ccuaaggucaggaguucaag

SEQ ID NO: 3889 - RNA, 20 nt, Artificial Sequence
  spacer sequence
ggaguucaagaccagccugg

SEQ ID NO: 3890 - RNA, 20 nt, Artificial Sequence
  spacer sequence
ugaccuuaggugauccgccu

SEQ ID NO: 3891 - RNA, 20 nt, Artificial Sequence
  spacer sequence
agaccagccuggccaacaug

SEQ ID NO: 3892 - RNA, 20 nt, Artificial Sequence
  spacer sequence
ugaacuccugaccuuaggug

SEQ ID NO: 3893 - RNA, 20 nt, Artificial Sequence
  spacer sequence
ccauguuggccaggcugguc

SEQ ID NO: 3894 - RNA, 20 nt, Artificial Sequence
  spacer sequence
cuacuaaaaauacaaaaauu

SEQ ID NO: 3895 - RNA, 20 nt, Artificial Sequence
  spacer sequence
acuaaaaauacaaaaauuag

SEQ ID NO: 3896 - RNA, 20 nt, Artificial Sequence
  spacer sequence
ggcuaauuuuuguauuuuua

SEQ ID NO: 3897 - RNA, 20 nt, Artificial Sequence
  spacer sequence
cagcuauucaggaugcugag

SEQ ID NO: 3898 - RNA, 20 nt, Artificial Sequence
  spacer sequence
ggaugcugaggcaagagaau

SEQ ID NO: 3899 - RNA, 20 nt, Artificial Sequence
  spacer sequence
ugaauagcugggacuacagg

SEQ ID NO: 3900 - RNA, 20 nt, Artificial Sequence
  spacer sequence
gcauccugaauagcugggac

SEQ ID NO: 3901 - RNA, 20 nt, Artificial Sequence
  spacer sequence
ugccucagcauccugaauag

SEQ ID NO: 3902 - RNA, 20 nt, Artificial Sequence
  spacer sequence
cuugccucagcauccugaau

SEQ ID NO: 3903 - RNA, 20 nt, Artificial Sequence
  spacer sequence
acuugggagguggagguugc

SEQ ID NO: 3904 - RNA, 20 nt, Artificial Sequence
  spacer sequence
caaguugaagcaauucucuu

SEQ ID NO: 3905 - RNA, 20 nt, Artificial Sequence
  spacer sequence
accucccaaguugaagcaau

SEQ ID NO: 3906 - RNA, 20 nt, Artificial Sequence
  spacer sequence
cugcaaccuccaccucccaa

SEQ ID NO: 3907 - RNA, 20 nt, Artificial Sequence
  spacer sequence
uggcucacugcaaccuccac

SEQ ID NO: 3908 - RNA, 20 nt, Artificial Sequence
  spacer sequence
agccugggcaacaagagcga

SEQ ID NO: 3909 - RNA, 20 nt, Artificial Sequence
  spacer sequence
uguugcccaggcuggaguac

SEQ ID NO: 3910 - RNA, 20 nt, Artificial Sequence
  spacer sequence
cucuuguugcccaggcugga

SEQ ID NO: 3911 - RNA, 20 nt, Artificial Sequence
  spacer sequence
gucuugaaaauaaauaaaug

SEQ ID NO: 3912 - RNA, 20 nt, Artificial Sequence
  spacer sequence
ugaaaauaaauaaaugaaua

SEQ ID NO: 3913 - RNA, 20 nt, Artificial Sequence
  spacer sequence
agacggaguuucgcucuugu

SEQ ID NO: 3914 - RNA, 20 nt, Artificial Sequence
  spacer sequence
uuuauuuauuuucaagacgg

SEQ ID NO: 3915 - RNA, 20 nt, Artificial Sequence
  spacer sequence
cauuuacuuuauuuuauuua

SEQ ID NO: 3916 - RNA, 20 nt, Artificial Sequence
  spacer sequence
gagccuuguucuauauagca

SEQ ID NO: 3917 - RNA, 20 nt, Artificial Sequence
  spacer sequence
gaaucacauuuacuuuauuu

SEQ ID NO: 3918 - RNA, 20 nt, Artificial Sequence
  spacer sequence
auauagcacuaaaagauuaa

SEQ ID NO: 3919 - RNA, 20 nt, Artificial Sequence
  spacer sequence
uuuagugcuauauagaacaa

SEQ ID NO: 3920 - RNA, 20 nt, Artificial Sequence
  spacer sequence
aagcacauguuguaagaaaa

SEQ ID NO: 3921 - RNA, 20 nt, Artificial Sequence
  spacer sequence
uacaacaugugcuuugaguu

SEQ ID NO: 3922 - RNA, 20 nt, Artificial Sequence
  spacer sequence
aguuuucuuacaacaugugc

SEQ ID NO: 3923 - RNA, 20 nt, Artificial Sequence
  spacer sequence
uccaguuuucuuacaacaug

SEQ ID NO: 3924 - RNA, 20 nt, Artificial Sequence
  spacer sequence
ucuuccaguuuucuuacaac

SEQ ID NO: 3925 - RNA, 20 nt, Artificial Sequence
  spacer sequence
uccucuuccaguuuucuuac

SEQ ID NO: 3926 - RNA, 20 nt, Artificial Sequence
  spacer sequence
cuuccucuuccaguuuucuu

SEQ ID NO: 3927 - RNA, 20 nt, Artificial Sequence
  spacer sequence
cgaucaaguagcauaggaag

SEQ ID NO: 3928 - RNA, 20 nt, Artificial Sequence
  spacer sequence
ggacucucuuccucuuccag

SEQ ID NO: 3929 - RNA, 20 nt, Artificial Sequence
  spacer sequence
aguagcauaggaagaagagu

SEQ ID NO: 3930 - RNA, 20 nt, Artificial Sequence
  spacer sequence
uaugcuacuugaucgggacu

SEQ ID NO: 3931 - RNA, 20 nt, Artificial Sequence
  spacer sequence
uccuaugcuacuugaucggg

SEQ ID NO: 3932 - RNA, 20 nt, Artificial Sequence
  spacer sequence
ucuuccuaugcuacuugauc

SEQ ID NO: 3933 - RNA, 20 nt, Artificial Sequence
  spacer sequence
uaaaaauaaaaacucuucuu

SEQ ID NO: 3934 - RNA, 20 nt, Artificial Sequence
  spacer sequence
uauauucauaaaaauaaaaa

SEQ ID NO: 3935 - RNA, 20 nt, Artificial Sequence
  spacer sequence
ccauguugcccaggcugguu

SEQ ID NO: 3936 - RNA, 20 nt, Artificial Sequence
  spacer sequence
cuacaaaaaaguacaaaagu

SEQ ID NO: 3937 - RNA, 20 nt, Artificial Sequence
  spacer sequence
acaaaaaaguacaaaaguac

SEQ ID NO: 3938 - RNA, 20 nt, Artificial Sequence
  spacer sequence
gacgugguggcacauaccug

SEQ ID NO: 3939 - RNA, 20 nt, Artificial Sequence
  spacer sequence
gaaaaaaaguacuuuuguac

SEQ ID NO: 3940 - RNA, 20 nt, Artificial Sequence
  spacer sequence
cagcuacuccagaggcuaag

SEQ ID NO: 3941 - RNA, 20 nt, Artificial Sequence
  spacer sequence
agaggcuaaggugggaggau

SEQ ID NO: 3942 - RNA, 20 nt, Artificial Sequence
  spacer sequence
ggaguagcugggacuacagg

SEQ ID NO: 3943 - RNA, 20 nt, Artificial Sequence
  spacer sequence
caccuuagccucuggaguag

SEQ ID NO: 3944 - RNA, 20 nt, Artificial Sequence
  spacer sequence
ucccaccuuagccucuggag

SEQ ID NO: 3945 - RNA, 20 nt, Artificial Sequence
  spacer sequence
cuugagccugggagagggag

SEQ ID NO: 3946 - RNA, 20 nt, Artificial Sequence
  spacer sequence
ugagccugggagagggaggc

SEQ ID NO: 3947 - RNA, 20 nt, Artificial Sequence
  spacer sequence
agagauccucccaccuuagc

SEQ ID NO: 3948 - RNA, 20 nt, Artificial Sequence
  spacer sequence
caggcucaagagauccuccc

SEQ ID NO: 3949 - RNA, 20 nt, Artificial Sequence
  spacer sequence
cccaggcucaagagauccuc

SEQ ID NO: 3950 - RNA, 20 nt, Artificial Sequence
  spacer sequence
cucucccaggcucaagagau

SEQ ID NO: 3951 - RNA, 20 nt, Artificial Sequence
  spacer sequence
cugcagccucccucucccag

SEQ ID NO: 3952 - RNA, 20 nt, Artificial Sequence
  spacer sequence
agccugggcaacacagcaag

SEQ ID NO: 3953 - RNA, 20 nt, Artificial Sequence
  spacer sequence
ugcuguguugcccaggcugg

SEQ ID NO: 3954 - RNA, 20 nt, Artificial Sequence
  spacer sequence
ccaaaaaaaaaaaaaaaaaa

SEQ ID NO: 3955 - RNA, 20 nt, Artificial Sequence
  spacer sequence
aaaaaaaaaaaaaaaaaaaa

SEQ ID NO: 3956 - RNA, 20 nt, Artificial Sequence
  spacer sequence
uuuuuuuuuuuuuuuuuuuu

SEQ ID NO: 3957 - RNA, 20 nt, Artificial Sequence
  spacer sequence
cuuuuuuuuuuuuuuuuuuu

SEQ ID NO: 3958 - RNA, 20 nt, Artificial Sequence
  spacer sequence
uauuuucucuuuuuuuuuuu

SEQ ID NO: 3959 - RNA, 20 nt, Artificial Sequence
  spacer sequence
aggguaugcuugcuuaucuu

SEQ ID NO: 3960 - RNA, 20 nt, Artificial Sequence
  spacer sequence
guugaaucaagaugcaugag

SEQ ID NO: 3961 - RNA, 20 nt, Artificial Sequence
  spacer sequence
acagaauguaugcuaaguac

SEQ ID NO: 3962 - RNA, 20 nt, Artificial Sequence
  spacer sequence
agaugcaugagagucuuaau

SEQ ID NO: 3963 - RNA, 20 nt, Artificial Sequence
  spacer sequence
ugauucaacagaauguaugc

SEQ ID NO: 3964 - RNA, 20 nt, Artificial Sequence
  spacer sequence
ugcaucuugauucaacagaa

SEQ ID NO: 3965 - RNA, 20 nt, Artificial Sequence
  spacer sequence
caugcaucuugauucaacag

SEQ ID NO: 3966 - RNA, 20 nt, Artificial Sequence
  spacer sequence
uaaugauaguuuacucauac

SEQ ID NO: 3967 - RNA, 20 nt, Artificial Sequence
  spacer sequence
uuaagacucucaugcaucuu

SEQ ID NO: 3968 - RNA, 20 nt, Artificial Sequence
  spacer sequence
uacuguacuuaauaugcaaa

SEQ ID NO: 3969 - RNA, 20 nt, Artificial Sequence
  spacer sequence
aauuuugcauauuaaguaca

SEQ ID NO: 3970 - RNA, 20 nt, Artificial Sequence
  spacer sequence
aguaagaacaaugauuagau

SEQ ID NO: 3971 - RNA, 20 nt, Artificial Sequence
  spacer sequence
uacuugauuauucuaauuuu

SEQ ID NO: 3972 - RNA, 20 nt, Artificial Sequence
  spacer sequence
uuguucuuacuugauuauuc

SEQ ID NO: 3973 - RNA, 20 nt, Artificial Sequence
  spacer sequence
aaucauuguucuuacuugau

SEQ ID NO: 3974 - RNA, 20 nt, Artificial Sequence
  spacer sequence
aaaaugaaugccaugugggg

SEQ ID NO: 3975 - RNA, 20 nt, Artificial Sequence
  spacer sequence
uuuuagaauuuaaaaauggc

SEQ ID NO: 3976 - RNA, 20 nt, Artificial Sequence
  spacer sequence
ccacauggcauucauuuuag

SEQ ID NO: 3977 - RNA, 20 nt, Artificial Sequence
  spacer sequence
uccccacauggcauucauuu

SEQ ID NO: 3978 - RNA, 20 nt, Artificial Sequence
  spacer sequence
cauccccacauggcauucau

SEQ ID NO: 3979 - RNA, 20 nt, Artificial Sequence
  spacer sequence
aggccagcacucucaucccc

SEQ ID NO: 3980 - RNA, 20 nt, Artificial Sequence
  spacer sequence
gaaaaccucgguucaagucu

SEQ ID NO: 3981 - RNA, 20 nt, Artificial Sequence
  spacer sequence
gaguucaaggccagcacucu

SEQ ID NO: 3982 - RNA, 20 nt, Artificial Sequence
  spacer sequence
guucaagucuggguuuuucc

SEQ ID NO: 3983 - RNA, 20 nt, Artificial Sequence
  spacer sequence
agucuggguuuuucccauuu

SEQ ID NO: 3984 - RNA, 20 nt, Artificial Sequence
  spacer sequence
ggguuuuucccauuucuagg

SEQ ID NO: 3985 - RNA, 20 nt, Artificial Sequence
  spacer sequence
cauuucuagguugugaucac

SEQ ID NO: 3986 - RNA, 20 nt, Artificial Sequence
  spacer sequence
agguugugaucacuucccuc

SEQ ID NO: 3987 - RNA, 20 nt, Artificial Sequence
  spacer sequence
caaccuagaaaugggaaaaa

SEQ ID NO: 3988 - RNA, 20 nt, Artificial Sequence
  spacer sequence
cuucccucccugaguccuua

SEQ ID NO: 3989 - RNA, 20 nt, Artificial Sequence
  spacer sequence
cucccugaguccuuaauuaa

SEQ ID NO: 3990 - RNA, 20 nt, Artificial Sequence
  spacer sequence
cugaguccuuaauuaaaaua

SEQ ID NO: 3991 - RNA, 20 nt, Artificial Sequence
  spacer sequence
gggagggaagugaucacaac

SEQ ID NO: 3992 - RNA, 20 nt, Artificial Sequence
  spacer sequence
uuaauuaaaauauccaguuu

SEQ ID NO: 3993 - RNA, 20 nt, Artificial Sequence
  spacer sequence
aguuuaggccgggcguggug

SEQ ID NO: 3994 - RNA, 20 nt, Artificial Sequence
  spacer sequence
cgccuguaauaccagcacuu

SEQ ID NO: 3995 - RNA, 20 nt, Artificial Sequence
  spacer sequence
aaagugcugguauuacaggc

SEQ ID NO: 3996 - RNA, 20 nt, Artificial Sequence
  spacer sequence
gcccuccaaagugcugguau

SEQ ID NO: 3997 - RNA, 20 nt, Artificial Sequence
  spacer sequence
acccgccucggcccuccaaa

SEQ ID NO: 3998 - RNA, 20 nt, Artificial Sequence
  spacer sequence
ugaggucaggagaucgaaac

SEQ ID NO: 3999 - RNA, 20 nt, Artificial Sequence
  spacer sequence
ugauccacccgccucggccc

SEQ ID NO: 4000 - RNA, 20 nt, Artificial Sequence
  spacer sequence
ggagaucgaaaccauccugg

SEQ ID NO: 4001 - RNA, 20 nt, Artificial Sequence
  spacer sequence
ugaccucaugauccacccgc

SEQ ID NO: 4002 - RNA, 20 nt, Artificial Sequence
  spacer sequence
ccugaccucaugauccaccc

SEQ ID NO: 4003 - RNA, 20 nt, Artificial Sequence
  spacer sequence
aaaccauccuggcuaacaca

SEQ ID NO: 4004 - RNA, 20 nt, Artificial Sequence
  spacer sequence
aucuccugaccucaugaucc

SEQ ID NO: 4005 - RNA, 20 nt, Artificial Sequence
  spacer sequence
uggcuaacacagugaaaccc

SEQ ID NO: 4006 - RNA, 20 nt, Artificial Sequence
  spacer sequence
cuguguuagccaggaugguu

SEQ ID NO: 4007 - RNA, 20 nt, Artificial Sequence
  spacer sequence
cuacuaaaaaauacaaaaaa

SEQ ID NO: 4008 - RNA, 20 nt, Artificial Sequence
  spacer sequence
acuaaaaaauacaaaaaauu

SEQ ID NO: 4009 - RNA, 20 nt, Artificial Sequence
  spacer sequence
ccaccacgcccggcuaauuu

SEQ ID NO: 4010 - RNA, 20 nt, Artificial Sequence
  spacer sequence
cgaguagucccagcuacucg

SEQ ID NO: 4011 - RNA, 20 nt, Artificial Sequence
  spacer sequence
ggagugcucaccaccacgcc

SEQ ID NO: 4012 - RNA, 20 nt, Artificial Sequence
  spacer sequence
cagcuacucgggaggcugag

SEQ ID NO: 4013 - RNA, 20 nt, Artificial Sequence
  spacer sequence
ggaggcugaggcaagagaau

SEQ ID NO: 4014 - RNA, 20 nt, Artificial Sequence
  spacer sequence
cgaguagcugggacuacucg

SEQ ID NO: 4015 - RNA, 20 nt, Artificial Sequence
  spacer sequence
gccucccgaguagcugggac

SEQ ID NO: 4016 - RNA, 20 nt, Artificial Sequence
  spacer sequence
ugccucagccucccgaguag

SEQ ID NO: 4017 - RNA, 20 nt, Artificial Sequence
  spacer sequence
cuugccucagccucccgagu

SEQ ID NO: 4018 - RNA, 20 nt, Artificial Sequence
  spacer sequence
caccauucucuugccucagc

SEQ ID NO: 4019 - RNA, 20 nt, Artificial Sequence
  spacer sequence
cggguucacaccauucucuu

SEQ ID NO: 4020 - RNA, 20 nt, Artificial Sequence
  spacer sequence
gccucccggguucacaccau

SEQ ID NO: 4021 - RNA, 20 nt, Artificial Sequence
  spacer sequence
gccgagaucacgccacugua

SEQ ID NO: 4022 - RNA, 20 nt, Artificial Sequence
  spacer sequence
gcugacugcaagcuccgccu

SEQ ID NO: 4023 - RNA, 20 nt, Artificial Sequence
  spacer sequence
cggcugacugcaagcuccgc

SEQ ID NO: 4024 - RNA, 20 nt, Artificial Sequence
  spacer sequence
cgccacuguacuccagccug

SEQ ID NO: 4025 - RNA, 20 nt, Artificial Sequence
  spacer sequence
agccugggcgacagagugag

SEQ ID NO: 4026 - RNA, 20 nt, Artificial Sequence
  spacer sequence
cccaggcuggaguacagugg

SEQ ID NO: 4027 - RNA, 20 nt, Artificial Sequence
  spacer sequence
gucgcccaggcuggaguaca

SEQ ID NO: 4028 - RNA, 20 nt, Artificial Sequence
  spacer sequence
cucugucgcccaggcuggag

SEQ ID NO: 4029 - RNA, 20 nt, Artificial Sequence
  spacer sequence
cacucugucgcccaggcugg

SEQ ID NO: 4030 - RNA, 20 nt, Artificial Sequence
  spacer sequence
gucucaaaaauaaaauaaaa

SEQ ID NO: 4031 - RNA, 20 nt, Artificial Sequence
  spacer sequence
caaaaauaaaauaaaauaaa

SEQ ID NO: 4032 - RNA, 20 nt, Artificial Sequence
  spacer sequence
aaaauaaaauaaaauaaaau

SEQ ID NO: 4033 - RNA, 20 nt, Artificial Sequence
  spacer sequence
aguuuauaaauagggauaac

SEQ ID NO: 4034 - RNA, 20 nt, Artificial Sequence
  spacer sequence
cuauuuauaaacuggauauu

SEQ ID NO: 4035 - RNA, 20 nt, Artificial Sequence
  spacer sequence
gucuggccugauaacaaggg

SEQ ID NO: 4036 - RNA, 20 nt, Artificial Sequence
  spacer sequence
ggccugauaacaagggcuug

SEQ ID NO: 4037 - RNA, 20 nt, Artificial Sequence
  spacer sequence
ggccagacagauauuguuau

SEQ ID NO: 4038 - RNA, 20 nt, Artificial Sequence
  spacer sequence
uuauugcauuuuguacuuac

SEQ ID NO: 4039 - RNA, 20 nt, Artificial Sequence
  spacer sequence
ccuuauugcauuuuguacuu

SEQ ID NO: 4040 - RNA, 20 nt, Artificial Sequence
  spacer sequence
uggacuuugacucucaguac

SEQ ID NO: 4041 - RNA, 20 nt, Artificial Sequence
  spacer sequence
augaauugcuuucuccuuau

SEQ ID NO: 4042 - RNA, 20 nt, Artificial Sequence
  spacer sequence
aaguccaugaauugcuuucu

SEQ ID NO: 4043 - RNA, 20 nt, Artificial Sequence
  spacer sequence
caguacccaggaaaagucuu

SEQ ID NO: 4044 - RNA, 20 nt, Artificial Sequence
  spacer sequence
guacccaggaaaagucuugu

SEQ ID NO: 4045 - RNA, 20 nt, Artificial Sequence
  spacer sequence
uggguacugagagucaaagu

SEQ ID NO: 4046 - RNA, 20 nt, Artificial Sequence
  spacer sequence
ugugcgugaaggaagaacau

SEQ ID NO: 4047 - RNA, 20 nt, Artificial Sequence
  spacer sequence
cgcacaagacuuuuccuggg

SEQ ID NO: 4048 - RNA, 20 nt, Artificial Sequence
  spacer sequence
uucacgcacaagacuuuucc

SEQ ID NO: 4049 - RNA, 20 nt, Artificial Sequence
  spacer sequence
uccuucacgcacaagacuuu

SEQ ID NO: 4050 - RNA, 20 nt, Artificial Sequence
  spacer sequence
auguucuuccuucacgcaca

SEQ ID NO: 4051 - RNA, 20 nt, Artificial Sequence
  spacer sequence
ucuauguucuuccuucacgc

SEQ ID NO: 4052 - RNA, 20 nt, Artificial Sequence
  spacer sequence
uuagugauaaggaccacagg

SEQ ID NO: 4053 - RNA, 20 nt, Artificial Sequence
  spacer sequence
cuaaugacuuccucuauguu

SEQ ID NO: 4054 - RNA, 20 nt, Artificial Sequence
  spacer sequence
uuaucacuaaugacuuccuc

SEQ ID NO: 4055 - RNA, 20 nt, Artificial Sequence
  spacer sequence
ugcccuuucuggcaaagaaa

SEQ ID NO: 4056 - RNA, 20 nt, Artificial Sequence
  spacer sequence
ggcaaagaaaaaggagagac

SEQ ID NO: 4057 - RNA, 20 nt, Artificial Sequence
  spacer sequence
uugccagaaagggcaggaau

SEQ ID NO: 4058 - RNA, 20 nt, Artificial Sequence
  spacer sequence
uuuuucuuugccagaaaggg

SEQ ID NO: 4059 - RNA, 20 nt, Artificial Sequence
  spacer sequence
ccuuuuucuuugccagaaag

SEQ ID NO: 4060 - RNA, 20 nt, Artificial Sequence
  spacer sequence
cuccuuuuucuuugccagaa

SEQ ID NO: 4061 - RNA, 20 nt, Artificial Sequence
  spacer sequence
aacucaagucauacaccaag

SEQ ID NO: 4062 - RNA, 20 nt, Artificial Sequence
  spacer sequence
agucauacaccaagucaguc

SEQ ID NO: 4063 - RNA, 20 nt, Artificial Sequence
  spacer sequence
uacaccaagucagucccuug

SEQ ID NO: 4064 - RNA, 20 nt, Artificial Sequence
  spacer sequence
gucccuugcacugcacauug

SEQ ID NO: 4065 - RNA, 20 nt, Artificial Sequence
  spacer sequence
cuugcacugcacauuguccu

SEQ ID NO: 4066 - RNA, 20 nt, Artificial Sequence
  spacer sequence
ugcugcuggcacuguccugg

SEQ ID NO: 4067 - RNA, 20 nt, Artificial Sequence
  spacer sequence
uggucuugccaguaauaggu

SEQ ID NO: 4068 - RNA, 20 nt, Artificial Sequence
  spacer sequence
ugccaguaauagguugggua

SEQ ID NO: 4069 - RNA, 20 nt, Artificial Sequence
  spacer sequence
uaaucuacugcccggaacuu

SEQ ID NO: 4070 - RNA, 20 nt, Artificial Sequence
  spacer sequence
acugcccggaacuuucagug

SEQ ID NO: 4071 - RNA, 20 nt, Artificial Sequence
  spacer sequence
gggcaguagauuaggauacc

SEQ ID NO: 4072 - RNA, 20 nt, Artificial Sequence
  spacer sequence
gugguuuccucuucaguuua

SEQ ID NO: 4073 - RNA, 20 nt, Artificial Sequence
  spacer sequence
ucuucaguuuaucuaguuaa

SEQ ID NO: 4074 - RNA, 20 nt, Artificial Sequence
  spacer sequence
ucaguuuaucuaguuaaaug

SEQ ID NO: 4075 - RNA, 20 nt, Artificial Sequence
  spacer sequence
guuuaucuaguuaaauguuc

SEQ ID NO: 4076 - RNA, 20 nt, Artificial Sequence
  spacer sequence
aguuaaauguucgggauaau

SEQ ID NO: 4077 - RNA, 20 nt, Artificial Sequence
  spacer sequence
ggauaauccuuccccucggc

SEQ ID NO: 4078 - RNA, 20 nt, Artificial Sequence
  spacer sequence
cgaacauuuaacuagauaaa

SEQ ID NO: 4079 - RNA, 20 nt, Artificial Sequence
  spacer sequence
uuccccucggcccccucccc

SEQ ID NO: 4080 - RNA, 20 nt, Artificial Sequence
  spacer sequence
ccucggcccccucccccaca

SEQ ID NO: 4081 - RNA, 20 nt, Artificial Sequence
  spacer sequence
gcccccucccccacaaguga

SEQ ID NO: 4082 - RNA, 20 nt, Artificial Sequence
  spacer sequence
cccacaagugaagaaacucc

SEQ ID NO: 4083 - RNA, 20 nt, Artificial Sequence
  spacer sequence
cuugugggggagggggccga

SEQ ID NO: 4084 - RNA, 20 nt, Artificial Sequence
  spacer sequence
ucacuugugggggagggggc

SEQ ID NO: 4085 - RNA, 20 nt, Artificial Sequence
  spacer sequence
aucucaaaauggcuucacca

SEQ ID NO: 4086 - RNA, 20 nt, Artificial Sequence
  spacer sequence
caaaauggcuucaccaaugc

SEQ ID NO: 4087 - RNA, 20 nt, Artificial Sequence
  spacer sequence
aaauggcuucaccaaugcug

SEQ ID NO: 4088 - RNA, 20 nt, Artificial Sequence
  spacer sequence
ccaaugcugagguguauuau

SEQ ID NO: 4089 - RNA, 20 nt, Artificial Sequence
  spacer sequence
gcauuggugaagccauuuug

SEQ ID NO: 4090 - RNA, 20 nt, Artificial Sequence
  spacer sequence
cgcagaagaagaaauccaga

SEQ ID NO: 4091 - RNA, 20 nt, Artificial Sequence
  spacer sequence
cagaagaagaaauccagaga

SEQ ID NO: 4092 - RNA, 20 nt, Artificial Sequence
  spacer sequence
gcgagauaauacaccucagc

SEQ ID NO: 4093 - RNA, 20 nt, Artificial Sequence
  spacer sequence
ucugcgagauaauacaccuc

SEQ ID NO: 4094 - RNA, 20 nt, Artificial Sequence
  spacer sequence
ucuucugcgagauaauacac

SEQ ID NO: 4095 - RNA, 20 nt, Artificial Sequence
  spacer sequence
agagaaaguguggcuucgug

SEQ ID NO: 4096 - RNA, 20 nt, Artificial Sequence
  spacer sequence
ggauuucuucuucugcgaga

SEQ ID NO: 4097 - RNA, 20 nt, Artificial Sequence
  spacer sequence
cuggauuucuucuucugcga

SEQ ID NO: 4098 - RNA, 20 nt, Artificial Sequence
  spacer sequence
uguuaacaaauacauggacu

SEQ ID NO: 4099 - RNA, 20 nt, Artificial Sequence
  spacer sequence
auguauuuguuaacacgaag

SEQ ID NO: 4100 - RNA, 20 nt, Artificial Sequence
  spacer sequence
aguccauguauuuguuaaca

SEQ ID NO: 4101 - RNA, 20 nt, Artificial Sequence
  spacer sequence
uccaguccauguauuuguua

SEQ ID NO: 4102 - RNA, 20 nt, Artificial Sequence
  spacer sequence
ucuuccaguccauguauuug

SEQ ID NO: 4103 - RNA, 20 nt, Artificial Sequence
  spacer sequence
guuagcucuaccacuuuugg

SEQ ID NO: 4104 - RNA, 20 nt, Artificial Sequence
  spacer sequence
accacuuuuggcuuguuuua

SEQ ID NO: 4105 - RNA, 20 nt, Artificial Sequence
  spacer sequence
aacucucauuacgucugcaa

SEQ ID NO: 4106 - RNA, 20 nt, Artificial Sequence
  spacer sequence
cauuacgucugcaagaugau

SEQ ID NO: 4107 - RNA, 20 nt, Artificial Sequence
  spacer sequence
uuacgucugcaagaugauug

SEQ ID NO: 4108 - RNA, 20 nt, Artificial Sequence
  spacer sequence
gcaagaugauugcucuagau

SEQ ID NO: 4109 - RNA, 20 nt, Artificial Sequence
  spacer sequence
ugcagacguaaugagaguua

SEQ ID NO: 4110 - RNA, 20 nt, Artificial Sequence
  spacer sequence
ucuugcagacguaaugagag

SEQ ID NO: 4111 - RNA, 20 nt, Artificial Sequence
  spacer sequence
agauguccaggagaagcagc

SEQ ID NO: 4112 - RNA, 20 nt, Artificial Sequence
  spacer sequence
agagcaaucaucuugcagac

SEQ ID NO: 4113 - RNA, 20 nt, Artificial Sequence
  spacer sequence
aggagaagcagcgagaucaa

SEQ ID NO: 4114 - RNA, 20 nt, Artificial Sequence
  spacer sequence
uggacaucuagagcaaucau

SEQ ID NO: 4115 - RNA, 20 nt, Artificial Sequence
  spacer sequence
ccuggacaucuagagcaauc

SEQ ID NO: 4116 - RNA, 20 nt, Artificial Sequence
  spacer sequence
cugcuucuccuggacaucua

SEQ ID NO: 4117 - RNA, 20 nt, Artificial Sequence
  spacer sequence
cgcugcuucuccuggacauc

SEQ ID NO: 4118 - RNA, 20 nt, Artificial Sequence
  spacer sequence
aguuuucuuuuuguguaucu

SEQ ID NO: 4119 - RNA, 20 nt, Artificial Sequence
  spacer sequence
uuuuguguaucuuuuuuguu

SEQ ID NO: 4120 - RNA, 20 nt, Artificial Sequence
  spacer sequence
uuuuuguuuguuuguuuuuu

SEQ ID NO: 4121 - RNA, 20 nt, Artificial Sequence
  spacer sequence
aaaaacaaacaaacaaaaaa

SEQ ID NO: 4122 - RNA, 20 nt, Artificial Sequence
  spacer sequence
caaaaaacaaacaaacaaaa

SEQ ID NO: 4123 - RNA, 20 nt, Artificial Sequence
  spacer sequence
gucucaaaaaacaaacaaac

SEQ ID NO: 4124 - RNA, 20 nt, Artificial Sequence
  spacer sequence
gucacccaggcuggagugca

SEQ ID NO: 4125 - RNA, 20 nt, Artificial Sequence
  spacer sequence
cccaggcuggagugcaguga

SEQ ID NO: 4126 - RNA, 20 nt, Artificial Sequence
  spacer sequence
agccugggugacagagcaag

SEQ ID NO: 4127 - RNA, 20 nt, Artificial Sequence
  spacer sequence
cugcacuccagccuggguga

SEQ ID NO: 4128 - RNA, 20 nt, Artificial Sequence
  spacer sequence
caucacugcacuccagccug

SEQ ID NO: 4129 - RNA, 20 nt, Artificial Sequence
  spacer sequence
cggcucacugcaaccucugu

SEQ ID NO: 4130 - RNA, 20 nt, Artificial Sequence
  spacer sequence
gcucacugcaaccucugucu

SEQ ID NO: 4131 - RNA, 20 nt, Artificial Sequence
  spacer sequence
cugcaaccucugucucccgg

SEQ ID NO: 4132 - RNA, 20 nt, Artificial Sequence
  spacer sequence
gucucccggguucaaguguu

SEQ ID NO: 4133 - RNA, 20 nt, Artificial Sequence
  spacer sequence
cccggguucaaguguucuuc

SEQ ID NO: 4134 - RNA, 20 nt, Artificial Sequence
  spacer sequence
cggguucaaguguucuuccu

SEQ ID NO: 4135 - RNA, 20 nt, Artificial Sequence
  spacer sequence
aguguucuuccugccucagc

SEQ ID NO: 4136 - RNA, 20 nt, Artificial Sequence
  spacer sequence
uccugccucagcuucccgag

SEQ ID NO: 4137 - RNA, 20 nt, Artificial Sequence
  spacer sequence
ugccucagcuucccgaguag

SEQ ID NO: 4138 - RNA, 20 nt, Artificial Sequence
  spacer sequence
gcuucccgaguagcugggac

SEQ ID NO: 4139 - RNA, 20 nt, Artificial Sequence
  spacer sequence
cgaguagcugggacuacagg

SEQ ID NO: 4140 - RNA, 20 nt, Artificial Sequence
  spacer sequence
ggaagcugaggcaggaagaa

SEQ ID NO: 4141 - RNA, 20 nt, Artificial Sequence
  spacer sequence
cagcuacucgggaagcugag

SEQ ID NO: 4142 - RNA, 20 nt, Artificial Sequence
  spacer sequence
auuaaaacauacaaaaguua

SEQ ID NO: 4143 - RNA, 20 nt, Artificial Sequence
  spacer sequence
ccauuaaaacauacaaaagu

SEQ ID NO: 4144 - RNA, 20 nt, Artificial Sequence
  spacer sequence
gccauguuggccaggcuggu

SEQ ID NO: 4145 - RNA, 20 nt, Artificial Sequence
  spacer sequence
cgaacuccuggccucaggug

SEQ ID NO: 4146 - RNA, 20 nt, Artificial Sequence
  spacer sequence
aacuccuggccucaggugau

SEQ ID NO: 4147 - RNA, 20 nt, Artificial Sequence
  spacer sequence
agaccagccuggccaacaug

SEQ ID NO: 4148 - RNA, 20 nt, Artificial Sequence
  spacer sequence
uggccucaggugauccgccu

SEQ ID NO: 4149 - RNA, 20 nt, Artificial Sequence
  spacer sequence
ggugauccgccugccucgga

SEQ ID NO: 4150 - RNA, 20 nt, Artificial Sequence
  spacer sequence
ccugaggccaggaguucgag

SEQ ID NO: 4151 - RNA, 20 nt, Artificial Sequence
  spacer sequence
gccugccucggacuuccaaa

SEQ ID NO: 4152 - RNA, 20 nt, Artificial Sequence
  spacer sequence
gacuuccaaagugcugggau

SEQ ID NO: 4153 - RNA, 20 nt, Artificial Sequence
  spacer sequence
gaggcaggcggaucaccuga

SEQ ID NO: 4154 - RNA, 20 nt, Artificial Sequence
  spacer sequence
aaagugcugggauuacaggc

SEQ ID NO: 4155 - RNA, 20 nt, Artificial Sequence
  spacer sequence
cagcacuuuggaaguccgag

SEQ ID NO: 4156 - RNA, 20 nt, Artificial Sequence
  spacer sequence
ugccuguaaucccagcacuu

SEQ ID NO: 4157 - RNA, 20 nt, Artificial Sequence
  spacer sequence
ggcaugguggcucaugccug

SEQ ID NO: 4158 - RNA, 20 nt, Artificial Sequence
  spacer sequence
uuuuuuuuguuguuuguuuu

SEQ ID NO: 4159 - RNA, 20 nt, Artificial Sequence
  spacer sequence
aaaaacaaacaacaaaaaaa

SEQ ID NO: 4160 - RNA, 20 nt, Artificial Sequence
  spacer sequence
caaaaaacaaacaacaaaaa

SEQ ID NO: 4161 - RNA, 20 nt, Artificial Sequence
  spacer sequence
cacucugucacccaggcugg

SEQ ID NO: 4162 - RNA, 20 nt, Artificial Sequence
  spacer sequence
cucugucacccaggcuggag

SEQ ID NO: 4163 - RNA, 20 nt, Artificial Sequence
  spacer sequence
gucacccaggcuggagugca

SEQ ID NO: 4164 - RNA, 20 nt, Artificial Sequence
  spacer sequence
cccaggcuggagugcagugg

SEQ ID NO: 4165 - RNA, 20 nt, Artificial Sequence
  spacer sequence
agccugggugacagagugag

SEQ ID NO: 4166 - RNA, 20 nt, Artificial Sequence
  spacer sequence
ugccacugcacuccagccug

SEQ ID NO: 4167 - RNA, 20 nt, Artificial Sequence
  spacer sequence
uggcucacugcagccuccac

SEQ ID NO: 4168 - RNA, 20 nt, Artificial Sequence
  spacer sequence
cugcagccuccaccucccag

SEQ ID NO: 4169 - RNA, 20 nt, Artificial Sequence
  spacer sequence
accucccagguucaagcaau

SEQ ID NO: 4170 - RNA, 20 nt, Artificial Sequence
  spacer sequence
cagguucaagcaauucuucc

SEQ ID NO: 4171 - RNA, 20 nt, Artificial Sequence
  spacer sequence
agcaauucuuccaccucagc

SEQ ID NO: 4172 - RNA, 20 nt, Artificial Sequence
  spacer sequence
uccaccucagccucccgagu

SEQ ID NO: 4173 - RNA, 20 nt, Artificial Sequence
  spacer sequence
accucagccucccgaguagc

SEQ ID NO: 4174 - RNA, 20 nt, Artificial Sequence
  spacer sequence
gccucccgaguagcugggau

SEQ ID NO: 4175 - RNA, 20 nt, Artificial Sequence
  spacer sequence
cgaguagcugggauuacagg

SEQ ID NO: 4176 - RNA, 20 nt, Artificial Sequence
  spacer sequence
ggaggcugagguggaagaau

SEQ ID NO: 4177 - RNA, 20 nt, Artificial Sequence
  spacer sequence
cagcuacucgggaggcugag

SEQ ID NO: 4178 - RNA, 20 nt, Artificial Sequence
  spacer sequence
aaaaaaaaaaaagccaggca

SEQ ID NO: 4179 - RNA, 20 nt, Artificial Sequence
  spacer sequence
caaaaaaaaaaaaagccagg

SEQ ID NO: 4180 - RNA, 20 nt, Artificial Sequence
  spacer sequence
gucucaaaaaaaaaaaaagc

SEQ ID NO: 4181 - RNA, 20 nt, Artificial Sequence
  spacer sequence
cacacuguugcccgggcugg

SEQ ID NO: 4182 - RNA, 20 nt, Artificial Sequence
  spacer sequence
cacuguugcccgggcuggag

SEQ ID NO: 4183 - RNA, 20 nt, Artificial Sequence
  spacer sequence
agcccgggcaacagugugag

SEQ ID NO: 4184 - RNA, 20 nt, Artificial Sequence
  spacer sequence
ugccacugcacuccagcccg

SEQ ID NO: 4185 - RNA, 20 nt, Artificial Sequence
  spacer sequence
uggcucacugcaguucaagc

SEQ ID NO: 4186 - RNA, 20 nt, Artificial Sequence
  spacer sequence
cugcaguucaagcaauucuc

SEQ ID NO: 4187 - RNA, 20 nt, Artificial Sequence
  spacer sequence
agcaauucuccugccuuagc

SEQ ID NO: 4188 - RNA, 20 nt, Artificial Sequence
  spacer sequence
ccugccuuagcccccugagu

SEQ ID NO: 4189 - RNA, 20 nt, Artificial Sequence
  spacer sequence
ugccuuagcccccugaguag

SEQ ID NO: 4190 - RNA, 20 nt, Artificial Sequence
  spacer sequence
gggggcuaaggcaggagaau

SEQ ID NO: 4191 - RNA, 20 nt, Artificial Sequence
  spacer sequence
cagcuacucagggggcuaag

SEQ ID NO: 4192 - RNA, 20 nt, Artificial Sequence
  spacer sequence
gcuaauuuuuuguauuuuua

SEQ ID NO: 4193 - RNA, 20 nt, Artificial Sequence
  spacer sequence
auuaaaaauacaaaaaauua

SEQ ID NO: 4194 - RNA, 20 nt, Artificial Sequence
  spacer sequence
cuauuaaaaauacaaaaaau

SEQ ID NO: 4195 - RNA, 20 nt, Artificial Sequence
  spacer sequence
ccauguuggccaggcugguc

SEQ ID NO: 4196 - RNA, 20 nt, Artificial Sequence
  spacer sequence
cgaacuccugaccucgugau

SEQ ID NO: 4197 - RNA, 20 nt, Artificial Sequence
  spacer sequence
aacuccugaccucgugauuc

SEQ ID NO: 4198 - RNA, 20 nt, Artificial Sequence
  spacer sequence
agaccagccuggccaacaug

SEQ ID NO: 4199 - RNA, 20 nt, Artificial Sequence
  spacer sequence
ugaccucgugauucgucugc

SEQ ID NO: 4200 - RNA, 20 nt, Artificial Sequence
  spacer sequence
ggaguucgagaccagccugg

SEQ ID NO: 4201 - RNA, 20 nt, Artificial Sequence
  spacer sequence
ugauucgucugccucggccu

SEQ ID NO: 4202 - RNA, 20 nt, Artificial Sequence
  spacer sequence
cgaggucaggaguucgagac

SEQ ID NO: 4203 - RNA, 20 nt, Artificial Sequence
  spacer sequence
ucugccucggccuuccaaag

SEQ ID NO: 4204 - RNA, 20 nt, Artificial Sequence
  spacer sequence
gccucggccuuccaaagugc

SEQ ID NO: 4205 - RNA, 20 nt, Artificial Sequence
  spacer sequence
gccuuccaaagugcugggag

SEQ ID NO: 4206 - RNA, 20 nt, Artificial Sequence
  spacer sequence
aaagugcugggaguacaggc

SEQ ID NO: 4207 - RNA, 20 nt, Artificial Sequence
  spacer sequence
cagcacuuuggaaggccgag

SEQ ID NO: 4208 - RNA, 20 nt, Artificial Sequence
  spacer sequence
ugccuguacucccagcacuu

SEQ ID NO: 4209 - RNA, 20 nt, Artificial Sequence
  spacer sequence
uuuuuaaaaggaaaagaaca

SEQ ID NO: 4210 - RNA, 20 nt, Artificial Sequence
  spacer sequence
uuuuaaaaaagauauacagg

SEQ ID NO: 4211 - RNA, 20 nt, Artificial Sequence
  spacer sequence
uuuccuuuuaaaaaagauau

SEQ ID NO: 4212 - RNA, 20 nt, Artificial Sequence
  spacer sequence
cagaaguuuccaacugaguu

SEQ ID NO: 4213 - RNA, 20 nt, Artificial Sequence
  spacer sequence
gggauauguucuuuuccuuu

SEQ ID NO: 4214 - RNA, 20 nt, Artificial Sequence
  spacer sequence
aacugaguuucccucugggu

SEQ ID NO: 4215 - RNA, 20 nt, Artificial Sequence
  spacer sequence
guuggaaacuucugggauau

SEQ ID NO: 4216 - RNA, 20 nt, Artificial Sequence
  spacer sequence
cucugggucaauaccagaau

SEQ ID NO: 4217 - RNA, 20 nt, Artificial Sequence
  spacer sequence
gggucaauaccagaauuggg

SEQ ID NO: 4218 - RNA, 20 nt, Artificial Sequence
  spacer sequence
auaccagaauuggguggggg

SEQ ID NO: 4219 - RNA, 20 nt, Artificial Sequence
  spacer sequence
gguauugacccagagggaaa

SEQ ID NO: 4220 - RNA, 20 nt, Artificial Sequence
  spacer sequence
ucagcucaccccuaaacuca

SEQ ID NO: 4221 - RNA, 20 nt, Artificial Sequence
  spacer sequence
gcucaccccuaaacucauca

SEQ ID NO: 4222 - RNA, 20 nt, Artificial Sequence
  spacer sequence
ccccuaaacucaucauugau

SEQ ID NO: 4223 - RNA, 20 nt, Artificial Sequence
  spacer sequence
ucauugauaagcagaaugaa

SEQ ID NO: 4224 - RNA, 20 nt, Artificial Sequence
  spacer sequence
uugauaagcagaaugaauga

SEQ ID NO: 4225 - RNA, 20 nt, Artificial Sequence
  spacer sequence
augaugaguuuaggggugag

SEQ ID NO: 4226 - RNA, 20 nt, Artificial Sequence
  spacer sequence
gcuuaucaaugaugaguuua

SEQ ID NO: 4227 - RNA, 20 nt, Artificial Sequence
  spacer sequence
uucugcuuaucaaugaugag

SEQ ID NO: 4228 - RNA, 20 nt, Artificial Sequence
  spacer sequence
uucauucugcuuaucaauga

SEQ ID NO: 4229 - RNA, 20 nt, Artificial Sequence
  spacer sequence
aaaccagccauggucauuca

SEQ ID NO: 4230 - RNA, 20 nt, Artificial Sequence
  spacer sequence
guugucuaaaccagccaugg

SEQ ID NO: 4231 - RNA, 20 nt, Artificial Sequence
  spacer sequence
gcuggccacauaaggaagga

SEQ ID NO: 4232 - RNA, 20 nt, Artificial Sequence
  spacer sequence
uuauguggccagcggaaauu

SEQ ID NO: 4233 - RNA, 20 nt, Artificial Sequence
  spacer sequence
uuccuuauguggccagcgga

SEQ ID NO: 4234 - RNA, 20 nt, Artificial Sequence
  spacer sequence
auccuuccuuauguggccag

SEQ ID NO: 4235 - RNA, 20 nt, Artificial Sequence
  spacer sequence
agugucuauccuuccuuaug

SEQ ID NO: 4236 - RNA, 20 nt, Artificial Sequence
  spacer sequence
ggucuaucagaguggaagaa

SEQ ID NO: 4237 - RNA, 20 nt, Artificial Sequence
  spacer sequence
aucagaguggaagaaaggga

SEQ ID NO: 4238 - RNA, 20 nt, Artificial Sequence
  spacer sequence
gaguggaagaaagggaagag

SEQ ID NO: 4239 - RNA, 20 nt, Artificial Sequence
  spacer sequence
gauagaccugauuuuguucu

SEQ ID NO: 4240 - RNA, 20 nt, Artificial Sequence
  spacer sequence
acucugauagaccugauuuu

SEQ ID NO: 4241 - RNA, 20 nt, Artificial Sequence
  spacer sequence
uccacucugauagaccugau

SEQ ID NO: 4242 - RNA, 20 nt, Artificial Sequence
  spacer sequence
cuuucuuccacucugauaga

SEQ ID NO: 4243 - RNA, 20 nt, Artificial Sequence
  spacer sequence
ucccuuucuuccacucugau

SEQ ID NO: 4244 - RNA, 20 nt, Artificial Sequence
  spacer sequence
ccaccagcccucuucccuuu

SEQ ID NO: 4245 - RNA, 20 nt, Artificial Sequence
  spacer sequence
uugccuccccaccagcccuc

SEQ ID NO: 4246 - RNA, 20 nt, Artificial Sequence
  spacer sequence
cuggcacuauucauugccuc

SEQ ID NO: 4247 - RNA, 20 nt, Artificial Sequence
  spacer sequence
aguucgcuggcacuauucau

SEQ ID NO: 4248 - RNA, 20 nt, Artificial Sequence
  spacer sequence
uccugacauuucgguucugc

SEQ ID NO: 4249 - RNA, 20 nt, Artificial Sequence
  spacer sequence
ugacauuucgguucugcucu

SEQ ID NO: 4250 - RNA, 20 nt, Artificial Sequence
  spacer sequence
ggaugauuuuccaguucgcu

SEQ ID NO: 4251 - RNA, 20 nt, Artificial Sequence
  spacer sequence
guucugcucuuugacuacgg

SEQ ID NO: 4252 - RNA, 20 nt, Artificial Sequence
  spacer sequence
gcucuuugacuacgguaacu

SEQ ID NO: 4253 - RNA, 20 nt, Artificial Sequence
  spacer sequence
uugacuacgguaacugugug

SEQ ID NO: 4254 - RNA, 20 nt, Artificial Sequence
  spacer sequence
aagagcagaaccgaaauguc

SEQ ID NO: 4255 - RNA, 20 nt, Artificial Sequence
  spacer sequence
ccuuuuaacuuacacacagu

SEQ ID NO: 4256 - RNA, 20 nt, Artificial Sequence
  spacer sequence
auccaucauuaccuuucuua

SEQ ID NO: 4257 - RNA, 20 nt, Artificial Sequence
  spacer sequence
aucauuaccuuucuuaucuc

SEQ ID NO: 4258 - RNA, 20 nt, Artificial Sequence
  spacer sequence
uuaccuuucuuaucucagau

SEQ ID NO: 4259 - RNA, 20 nt, Artificial Sequence
  spacer sequence
uaucucagauagcuaagaga

SEQ ID NO: 4260 - RNA, 20 nt, Artificial Sequence
  spacer sequence
cagauagcuaagagacauca

SEQ ID NO: 4261 - RNA, 20 nt, Artificial Sequence
  spacer sequence
gauagcuaagagacaucaug

SEQ ID NO: 4262 - RNA, 20 nt, Artificial Sequence
  spacer sequence
gagauaagaaagguaaugau

SEQ ID NO: 4263 - RNA, 20 nt, Artificial Sequence
  spacer sequence
uagcuaucugagauaagaaa

SEQ ID NO: 4264 - RNA, 20 nt, Artificial Sequence
  spacer sequence
cuuagcuaucugagauaaga

SEQ ID NO: 4265 - RNA, 20 nt, Artificial Sequence
  spacer sequence
ugaacuuaacuguguccaaa

SEQ ID NO: 4266 - RNA, 20 nt, Artificial Sequence
  spacer sequence
ugaugucucuuagcuaucug

SEQ ID NO: 4267 - RNA, 20 nt, Artificial Sequence
  spacer sequence
aaaaugaaacuacuggucuu

SEQ ID NO: 4268 - RNA, 20 nt, Artificial Sequence
  spacer sequence
uuuuggacacaguuaaguuc

SEQ ID NO: 4269 - RNA, 20 nt, Artificial Sequence
  spacer sequence
ucuuccucacaucugcucca

SEQ ID NO: 4270 - RNA, 20 nt, Artificial Sequence
  spacer sequence
uccucacaucugcuccacug

SEQ ID NO: 4271 - RNA, 20 nt, Artificial Sequence
  spacer sequence
ucacaucugcuccacuggca

SEQ ID NO: 4272 - RNA, 20 nt, Artificial Sequence
  spacer sequence
caucugcuccacuggcagcc

SEQ ID NO: 4273 - RNA, 20 nt, Artificial Sequence
  spacer sequence
gcuccacuggcagccuccuu

SEQ ID NO: 4274 - RNA, 20 nt, Artificial Sequence
  spacer sequence
acuggcagccuccuuggcca

SEQ ID NO: 4275 - RNA, 20 nt, Artificial Sequence
  spacer sequence
uuggccauauuaauuaacaa

SEQ ID NO: 4276 - RNA, 20 nt, Artificial Sequence
  spacer sequence
uucuauugaaccaacaccuu

SEQ ID NO: 4277 - RNA, 20 nt, Artificial Sequence
  spacer sequence
auugaaccaacaccuuggag

SEQ ID NO: 4278 - RNA, 20 nt, Artificial Sequence
  spacer sequence
auagaaggaguuguuguuaa

SEQ ID NO: 4279 - RNA, 20 nt, Artificial Sequence
  spacer sequence
aagguguugguucaauagaa

SEQ ID NO: 4280 - RNA, 20 nt, Artificial Sequence
  spacer sequence
uggacucuuguccucuugca

SEQ ID NO: 4281 - RNA, 20 nt, Artificial Sequence
  spacer sequence
aggauaacuccaagguguug

SEQ ID NO: 4282 - RNA, 20 nt, Artificial Sequence
  spacer sequence
uguccucuugcauucaacgu

SEQ ID NO: 4283 - RNA, 20 nt, Artificial Sequence
  spacer sequence
ucuugcauucaacgucuuaa

SEQ ID NO: 4284 - RNA, 20 nt, Artificial Sequence
  spacer sequence
ugcauucaacgucuuaacca

SEQ ID NO: 4285 - RNA, 20 nt, Artificial Sequence
  spacer sequence
acgucuuaaccauuggcaaa

SEQ ID NO: 4286 - RNA, 20 nt, Artificial Sequence
  spacer sequence
uaaccauuggcaaauccuac

SEQ ID NO: 4287 - RNA, 20 nt, Artificial Sequence
  spacer sequence
uacuggcaugaccuuugaaa

SEQ ID NO: 4288 - RNA, 20 nt, Artificial Sequence
  spacer sequence
ugccaguaggauuugccaau

SEQ ID NO: 4289 - RNA, 20 nt, Artificial Sequence
  spacer sequence
aaggucaugccaguaggauu

SEQ ID NO: 4290 - RNA, 20 nt, Artificial Sequence
  spacer sequence
cugggccccaaguuggguac

SEQ ID NO: 4291 - RNA, 20 nt, Artificial Sequence
  spacer sequence
cugccacaguucccugggcc

SEQ ID NO: 4292 - RNA, 20 nt, Artificial Sequence
  spacer sequence
cccaaaucccugccacaguu

SEQ ID NO: 4293 - RNA, 20 nt, Artificial Sequence
  spacer sequence
cuaccucagcaugaaaccca

SEQ ID NO: 4294 - RNA, 20 nt, Artificial Sequence
  spacer sequence
accucagcaugaaacccagc

SEQ ID NO: 4295 - RNA, 20 nt, Artificial Sequence
  spacer sequence
gcaugaaacccagcccugcu

SEQ ID NO: 4296 - RNA, 20 nt, Artificial Sequence
  spacer sequence
ugcugagguagagaguuaua

SEQ ID NO: 4297 - RNA, 20 nt, Artificial Sequence
  spacer sequence
aguaccagagaaauaggggg

SEQ ID NO: 4298 - RNA, 20 nt, Artificial Sequence
  spacer sequence
gguacuggagcagggcuggg

SEQ ID NO: 4299 - RNA, 20 nt, Artificial Sequence
  spacer sequence
cugguacuggagcagggcug

SEQ ID NO: 4300 - RNA, 20 nt, Artificial Sequence
  spacer sequence
ggagguagcacccuuggcau

SEQ ID NO: 4301 - RNA, 20 nt, Artificial Sequence
  spacer sequence
agauacccccuauuucucug

SEQ ID NO: 4302 - RNA, 20 nt, Artificial Sequence
  spacer sequence
augccaagggugcuaccucc

SEQ ID NO: 4303 - RNA, 20 nt, Artificial Sequence
  spacer sequence
ucaugauggcaguggcagug

SEQ ID NO: 4304 - RNA, 20 nt, Artificial Sequence
  spacer sequence
ugauggcaguggcaguggua

SEQ ID NO: 4305 - RNA, 20 nt, Artificial Sequence
  spacer sequence
ugaggacacccaauuccaug

SEQ ID NO: 4306 - RNA, 20 nt, Artificial Sequence
  spacer sequence
cguggcucugugaaugaugg

SEQ ID NO: 4307 - RNA, 20 nt, Artificial Sequence
  spacer sequence
gugaaugauggacaggaaca

SEQ ID NO: 4308 - RNA, 20 nt, Artificial Sequence
  spacer sequence
cagagccacgugaaguuuua

SEQ ID NO: 4309 - RNA, 20 nt, Artificial Sequence
  spacer sequence
uucacagagccacgugaagu

SEQ ID NO: 4310 - RNA, 20 nt, Artificial Sequence
  spacer sequence
aucauucacagagccacgug

SEQ ID NO: 4311 - RNA, 20 nt, Artificial Sequence
  spacer sequence
uguccaucauucacagagcc

SEQ ID NO: 4312 - RNA, 20 nt, Artificial Sequence
  spacer sequence
uguuccuguccaucauucac

SEQ ID NO: 4313 - RNA, 20 nt, Artificial Sequence
  spacer sequence
gguuucuuguuccuguccau

SEQ ID NO: 4314 - RNA, 20 nt, Artificial Sequence
  spacer sequence
ggucugguuucuuguuccug

SEQ ID NO: 4315 - RNA, 20 nt, Artificial Sequence
  spacer sequence
ucuggucugguuucuuguuc

SEQ ID NO: 4316 - RNA, 20 nt, Artificial Sequence
  spacer sequence
ucuucuggucugguuucuug

SEQ ID NO: 4317 - RNA, 20 nt, Artificial Sequence
  spacer sequence
uccucuucuggucugguuuc

SEQ ID NO: 4318 - RNA, 20 nt, Artificial Sequence
  spacer sequence
uguuccuccucuucuggucu

SEQ ID NO: 4319 - RNA, 20 nt, Artificial Sequence
  spacer sequence
gucuuguuccuccucuucug

SEQ ID NO: 4320 - RNA, 20 nt, Artificial Sequence
  spacer sequence
gccucugucuuguuccuccu

SEQ ID NO: 4321 - RNA, 20 nt, Artificial Sequence
  spacer sequence
ccacccaaaucucaccuuga

SEQ ID NO: 4322 - RNA, 20 nt, Artificial Sequence
  spacer sequence
caccuugaauugcgacuccc

SEQ ID NO: 4323 - RNA, 20 nt, Artificial Sequence
  spacer sequence
ccuugaauugcgacucccac

SEQ ID NO: 4324 - RNA, 20 nt, Artificial Sequence
  spacer sequence
aggugagauuugggugggga

SEQ ID NO: 4325 - RNA, 20 nt, Artificial Sequence
  spacer sequence
caauucaaggugagauuugg

SEQ ID NO: 4326 - RNA, 20 nt, Artificial Sequence
  spacer sequence
cacaauucccacguaucaug

SEQ ID NO: 4327 - RNA, 20 nt, Artificial Sequence
  spacer sequence
cacguaucaugggagaaacc

SEQ ID NO: 4328 - RNA, 20 nt, Artificial Sequence
  spacer sequence
ugggagaaaccuggugggag

SEQ ID NO: 4329 - RNA, 20 nt, Artificial Sequence
  spacer sequence
caugauacgugggaauugug

SEQ ID NO: 4330 - RNA, 20 nt, Artificial Sequence
  spacer sequence
cccaugauacgugggaauug

SEQ ID NO: 4331 - RNA, 20 nt, Artificial Sequence
  spacer sequence
caccagguuucucccaugau

SEQ ID NO: 4332 - RNA, 20 nt, Artificial Sequence
  spacer sequence
uucccauguuguucuuguga

SEQ ID NO: 4333 - RNA, 20 nt, Artificial Sequence
  spacer sequence
cauguuguucuugugauccu

SEQ ID NO: 4334 - RNA, 20 nt, Artificial Sequence
  spacer sequence
ugugauccugaauaagucuc

SEQ ID NO: 4335 - RNA, 20 nt, Artificial Sequence
  spacer sequence
caagaacaacaugggaaaga

SEQ ID NO: 4336 - RNA, 20 nt, Artificial Sequence
  spacer sequence
ugaauaagucucaugagauc

SEQ ID NO: 4337 - RNA, 20 nt, Artificial Sequence
  spacer sequence
ggaucacaagaacaacaugg

SEQ ID NO: 4338 - RNA, 20 nt, Artificial Sequence
  spacer sequence
caugagaucuggugguuuua

SEQ ID NO: 4339 - RNA, 20 nt, Artificial Sequence
  spacer sequence
ugagaucuggugguuuuaaa

SEQ ID NO: 4340 - RNA, 20 nt, Artificial Sequence
  spacer sequence
ugagacuuauucaggaucac

SEQ ID NO: 4341 - RNA, 20 nt, Artificial Sequence
  spacer sequence
caugagacuuauucaggauc

SEQ ID NO: 4342 - RNA, 20 nt, Artificial Sequence
  spacer sequence
ggugguuuuaaaaaugggag

SEQ ID NO: 4343 - RNA, 20 nt, Artificial Sequence
  spacer sequence
cauuuuuaaaaccaccagau

SEQ ID NO: 4344 - RNA, 20 nt, Artificial Sequence
  spacer sequence
agcugggcacaguggcucau

SEQ ID NO: 4345 - RNA, 20 nt, Artificial Sequence
  spacer sequence
ugccuguaauccuagcacuu

SEQ ID NO: 4346 - RNA, 20 nt, Artificial Sequence
  spacer sequence
uagcacuuugggaggccgag

SEQ ID NO: 4347 - RNA, 20 nt, Artificial Sequence
  spacer sequence
caaagugcuaggauuacagg

SEQ ID NO: 4348 - RNA, 20 nt, Artificial Sequence
  spacer sequence
gccucccaaagugcuaggau

SEQ ID NO: 4349 - RNA, 20 nt, Artificial Sequence
  spacer sequence
acccaccucggccucccaaa

SEQ ID NO: 4350 - RNA, 20 nt, Artificial Sequence
  spacer sequence
ccugaggucaggcguuugag

SEQ ID NO: 4351 - RNA, 20 nt, Artificial Sequence
  spacer sequence
ggugauccacccaccucggc

SEQ ID NO: 4352 - RNA, 20 nt, Artificial Sequence
  spacer sequence
ggcguuugagaccagccugg

SEQ ID NO: 4353 - RNA, 20 nt, Artificial Sequence
  spacer sequence
aacgccugaccucaggugau

SEQ ID NO: 4354 - RNA, 20 nt, Artificial Sequence
  spacer sequence
caaacgccugaccucaggug

SEQ ID NO: 4355 - RNA, 20 nt, Artificial Sequence
  spacer sequence
cuagugaagaaacaaaaaaa

SEQ ID NO: 4356 - RNA, 20 nt, Artificial Sequence
  spacer sequence
agugaagaaacaaaaaaauu

SEQ ID NO: 4357 - RNA, 20 nt, Artificial Sequence
  spacer sequence
cuagagacgggguuuugcca

SEQ ID NO: 4358 - RNA, 20 nt, Artificial Sequence
  spacer sequence
ucacuagagacgggguuuug

SEQ ID NO: 4359 - RNA, 20 nt, Artificial Sequence
  spacer sequence
cuguagucccaacuaccugg

SEQ ID NO: 4360 - RNA, 20 nt, Artificial Sequence
  spacer sequence
caacuaccugggaggcugag

SEQ ID NO: 4361 - RNA, 20 nt, Artificial Sequence
  spacer sequence
cagguaguugggacuacagg

SEQ ID NO: 4362 - RNA, 20 nt, Artificial Sequence
  spacer sequence
gccucccagguaguugggac

SEQ ID NO: 4363 - RNA, 20 nt, Artificial Sequence
  spacer sequence
ugccucagccucccagguag

SEQ ID NO: 4364 - RNA, 20 nt, Artificial Sequence
  spacer sequence
cuugaauccgggagguggag

SEQ ID NO: 4365 - RNA, 20 nt, Artificial Sequence
  spacer sequence
agggauuuuccugccucagc

SEQ ID NO: 4366 - RNA, 20 nt, Artificial Sequence
  spacer sequence
gggagguggaggcugcagug

SEQ ID NO: 4367 - RNA, 20 nt, Artificial Sequence
  spacer sequence
cggauucaagggauuuuccu

SEQ ID NO: 4368 - RNA, 20 nt, Artificial Sequence
  spacer sequence
accucccggauucaagggau

SEQ ID NO: 4369 - RNA, 20 nt, Artificial Sequence
  spacer sequence
cugcagccuccaccucccgg

SEQ ID NO: 4370 - RNA, 20 nt, Artificial Sequence
  spacer sequence
uggcucacugcagccuccac

SEQ ID NO: 4371 - RNA, 20 nt, Artificial Sequence
  spacer sequence
caccauugcacuccagccug

SEQ ID NO: 4372 - RNA, 20 nt, Artificial Sequence
  spacer sequence
agccugggcaacaagaguga

SEQ ID NO: 4373 - RNA, 20 nt, Artificial Sequence
  spacer sequence
uguugcccaggcuggagugc

SEQ ID NO: 4374 - RNA, 20 nt, Artificial Sequence
  spacer sequence
cucuuguugcccaggcugga

SEQ ID NO: 4375 - RNA, 20 nt, Artificial Sequence
  spacer sequence
aucucaaaaaaaaaaaaaaa

SEQ ID NO: 4376 - RNA, 20 nt, Artificial Sequence
  spacer sequence
caaaaaaaaaaaaaaaaaaa

SEQ ID NO: 4377 - RNA, 20 nt, Artificial Sequence
  spacer sequence
aaaaaaaaaaaaaaaaaaaa

SEQ ID NO: 4378 - RNA, 20 nt, Artificial Sequence
  spacer sequence
cacuucuaaucccagcacuu

SEQ ID NO: 4379 - RNA, 20 nt, Artificial Sequence
  spacer sequence
aaucccagcacuuugggagg

SEQ ID NO: 4380 - RNA, 20 nt, Artificial Sequence
  spacer sequence
cagcacuuugggaggcugag

SEQ ID NO: 4381 - RNA, 20 nt, Artificial Sequence
  spacer sequence
caaagugcugggauuagaag

SEQ ID NO: 4382 - RNA, 20 nt, Artificial Sequence
  spacer sequence
gccucccaaagugcugggau

SEQ ID NO: 4383 - RNA, 20 nt, Artificial Sequence
  spacer sequence
acccaccucagccucccaaa

SEQ ID NO: 4384 - RNA, 20 nt, Artificial Sequence
  spacer sequence
cgaggucaggagauugagac

SEQ ID NO: 4385 - RNA, 20 nt, Artificial Sequence
  spacer sequence
ugauccacccaccucagccu

SEQ ID NO: 4386 - RNA, 20 nt, Artificial Sequence
  spacer sequence
ggagauugagaccauccugg

SEQ ID NO: 4387 - RNA, 20 nt, Artificial Sequence
  spacer sequence
ugaccucgugauccacccac

SEQ ID NO: 4388 - RNA, 20 nt, Artificial Sequence
  spacer sequence
ccugaccucgugauccaccc

SEQ ID NO: 4389 - RNA, 20 nt, Artificial Sequence
  spacer sequence
aucuccugaccucgugaucc

SEQ ID NO: 4390 - RNA, 20 nt, Artificial Sequence
  spacer sequence
caaucuccugaccucgugau

SEQ ID NO: 4391 - RNA, 20 nt, Artificial Sequence
  spacer sequence
uggcuaacacggugaaaccc

SEQ ID NO: 4392 - RNA, 20 nt, Artificial Sequence
  spacer sequence
ccguguuagccaggaugguc

SEQ ID NO: 4393 - RNA, 20 nt, Artificial Sequence
  spacer sequence
cuacuaaaaauacaaaaaau

SEQ ID NO: 4394 - RNA, 20 nt, Artificial Sequence
  spacer sequence
acuaaaaauacaaaaaauua

SEQ ID NO: 4395 - RNA, 20 nt, Artificial Sequence
  spacer sequence
cgccaccacgcccagcuaau

SEQ ID NO: 4396 - RNA, 20 nt, Artificial Sequence
  spacer sequence
cagcuacucgggaggcuaag

SEQ ID NO: 4397 - RNA, 20 nt, Artificial Sequence
  spacer sequence
gcuacucgggaggcuaaggc

SEQ ID NO: 4398 - RNA, 20 nt, Artificial Sequence
  spacer sequence
ggaggcuaaggcaggagaau

SEQ ID NO: 4399 - RNA, 20 nt, Artificial Sequence
  spacer sequence
cgaguagcugagacuacugg

SEQ ID NO: 4400 - RNA, 20 nt, Artificial Sequence
  spacer sequence
ugccuuagccucccgaguag

SEQ ID NO: 4401 - RNA, 20 nt, Artificial Sequence
  spacer sequence
ccugccuuagccucccgagu

SEQ ID NO: 4402 - RNA, 20 nt, Artificial Sequence
  spacer sequence
aacccauucuccugccuuag

SEQ ID NO: 4403 - RNA, 20 nt, Artificial Sequence
  spacer sequence
uggagguggagcuugcagug

SEQ ID NO: 4404 - RNA, 20 nt, Artificial Sequence
  spacer sequence
aggauucaaacccauucucc

SEQ ID NO: 4405 - RNA, 20 nt, Artificial Sequence
  spacer sequence
accuccaggauucaaaccca

SEQ ID NO: 4406 - RNA, 20 nt, Artificial Sequence
  spacer sequence
cugcaagcuccaccuccagg

SEQ ID NO: 4407 - RNA, 20 nt, Artificial Sequence
  spacer sequence
gcucacugcaagcuccaccu

SEQ ID NO: 4408 - RNA, 20 nt, Artificial Sequence
  spacer sequence
cggcucacugcaagcuccac

SEQ ID NO: 4409 - RNA, 20 nt, Artificial Sequence
  spacer sequence
agccugggcgacagagugag

SEQ ID NO: 4410 - RNA, 20 nt, Artificial Sequence
  spacer sequence
cccaggcuggagugcagugg

SEQ ID NO: 4411 - RNA, 20 nt, Artificial Sequence
  spacer sequence
gucgcccaggcuggagugca

SEQ ID NO: 4412 - RNA, 20 nt, Artificial Sequence
  spacer sequence
cucugucgcccaggcuggag

SEQ ID NO: 4413 - RNA, 20 nt, Artificial Sequence
  spacer sequence
cacucugucgcccaggcugg

SEQ ID NO: 4414 - RNA, 20 nt, Artificial Sequence
  spacer sequence
aucucaaaaaaaaaaaaaaa

SEQ ID NO: 4415 - RNA, 20 nt, Artificial Sequence
  spacer sequence
caaaaaaaaaaaaaaaaaaa

SEQ ID NO: 4416 - RNA, 20 nt, Artificial Sequence
  spacer sequence
aaaaaaaaaaaaaaaaaaga

SEQ ID NO: 4417 - RNA, 20 nt, Artificial Sequence
  spacer sequence
uuuuuuuuuuuuuuuuuuga

SEQ ID NO: 4418 - RNA, 20 nt, Artificial Sequence
  spacer sequence
gguauuucuuuuuuuuuuuu

SEQ ID NO: 4419 - RNA, 20 nt, Artificial Sequence
  spacer sequence
cagguauuucuuuuuuuuuu

SEQ ID NO: 4420 - RNA, 20 nt, Artificial Sequence
  spacer sequence
cagucucagguauuucuuuu

SEQ ID NO: 4421 - RNA, 20 nt, Artificial Sequence
  spacer sequence
uuauaaauuucccagucuca

SEQ ID NO: 4422 - RNA, 20 nt, Artificial Sequence
  spacer sequence
uuucuuuauaaauuucccag

SEQ ID NO: 4423 - RNA, 20 nt, Artificial Sequence
  spacer sequence
cgguucugcaggcuguacaa

SEQ ID NO: 4424 - RNA, 20 nt, Artificial Sequence
  spacer sequence
gcaggcuguacaagcauggc

SEQ ID NO: 4425 - RNA, 20 nt, Artificial Sequence
  spacer sequence
cucagcuucauggggggggc

SEQ ID NO: 4426 - RNA, 20 nt, Artificial Sequence
  spacer sequence
gcuucauggggggggccuca

SEQ ID NO: 4427 - RNA, 20 nt, Artificial Sequence
  spacer sequence
uggggggggccucagggagc

SEQ ID NO: 4428 - RNA, 20 nt, Artificial Sequence
  spacer sequence
gggagcuuuuauucauggca

SEQ ID NO: 4429 - RNA, 20 nt, Artificial Sequence
  spacer sequence
cugaggccccccccaugaag

SEQ ID NO: 4430 - RNA, 20 nt, Artificial Sequence
  spacer sequence
uggcagaaggcaauguggga

SEQ ID NO: 4431 - RNA, 20 nt, Artificial Sequence
  spacer sequence
gccaugaauaaaagcucccu

SEQ ID NO: 4432 - RNA, 20 nt, Artificial Sequence
  spacer sequence
cacauugccuucugccauga

SEQ ID NO: 4433 - RNA, 20 nt, Artificial Sequence
  spacer sequence
cauggugaaagcaggagcaa

SEQ ID NO: 4434 - RNA, 20 nt, Artificial Sequence
  spacer sequence
ccaugugaaaugccugcucc

SEQ ID NO: 4435 - RNA, 20 nt, Artificial Sequence
  spacer sequence
ugcuuucaccaugugaaaug

SEQ ID NO: 4436 - RNA, 20 nt, Artificial Sequence
  spacer sequence
ugcuccugcuuucaccaugu

SEQ ID NO: 4437 - RNA, 20 nt, Artificial Sequence
  spacer sequence
cuugcuccugcuuucaccau

SEQ ID NO: 4438 - RNA, 20 nt, Artificial Sequence
  spacer sequence
cucuugcuccugcuuucacc

SEQ ID NO: 4439 - RNA, 20 nt, Artificial Sequence
  spacer sequence
cucucuugcuccugcuuuca

SEQ ID NO: 4440 - RNA, 20 nt, Artificial Sequence
  spacer sequence
cccacucucucucuugcucc

SEQ ID NO: 4441 - RNA, 20 nt, Artificial Sequence
  spacer sequence
ucccccacucucucucuugc

SEQ ID NO: 4442 - RNA, 20 nt, Artificial Sequence
  spacer sequence
uuuuugggcuaugcaaauuc

SEQ ID NO: 4443 - RNA, 20 nt, Artificial Sequence
  spacer sequence
ccaguugcaccccgggucua

SEQ ID NO: 4444 - RNA, 20 nt, Artificial Sequence
  spacer sequence
aguugcaccccgggucuaau

SEQ ID NO: 4445 - RNA, 20 nt, Artificial Sequence
  spacer sequence
aaugaaucagaaacacuggg

SEQ ID NO: 4446 - RNA, 20 nt, Artificial Sequence
  spacer sequence
uuagacccggggugcaacug

SEQ ID NO: 4447 - RNA, 20 nt, Artificial Sequence
  spacer sequence
gaaacacuggggguggaagc

SEQ ID NO: 4448 - RNA, 20 nt, Artificial Sequence
  spacer sequence
gauucauuagacccggggug

SEQ ID NO: 4449 - RNA, 20 nt, Artificial Sequence
  spacer sequence
acccccaguguuucugauuc

SEQ ID NO: 4450 - RNA, 20 nt, Artificial Sequence
  spacer sequence
agcuacagccaugugaaaag

SEQ ID NO: 4451 - RNA, 20 nt, Artificial Sequence
  spacer sequence
cauggcuguagcuggaaaua

SEQ ID NO: 4452 - RNA, 20 nt, Artificial Sequence
  spacer sequence
gcaaauccucuccccagaaa

SEQ ID NO: 4453 - RNA, 20 nt, Artificial Sequence
  spacer sequence
ucuccccagaaagcaacuau

SEQ ID NO: 4454 - RNA, 20 nt, Artificial Sequence
  spacer sequence
ccccagaaagcaacuauaag

SEQ ID NO: 4455 - RNA, 20 nt, Artificial Sequence
  spacer sequence
ccagaaagcaacuauaaguc

SEQ ID NO: 4456 - RNA, 20 nt, Artificial Sequence
  spacer sequence
ggggagaggauuugcugacu

SEQ ID NO: 4457 - RNA, 20 nt, Artificial Sequence
  spacer sequence
gaacaaaauugacaagaaca

SEQ ID NO: 4458 - RNA, 20 nt, Artificial Sequence
  spacer sequence
gacuuauaguugcuuucugg

SEQ ID NO: 4459 - RNA, 20 nt, Artificial Sequence
  spacer sequence
auuuuguucagacuuauagu

SEQ ID NO: 4460 - RNA, 20 nt, Artificial Sequence
  spacer sequence
ugucaauuuuguucagacuu

SEQ ID NO: 4461 - RNA, 20 nt, Artificial Sequence
  spacer sequence
ggaaaucaauaaaacucaua

SEQ ID NO: 4462 - RNA, 20 nt, Artificial Sequence
  spacer sequence
agagcaccaaaauaguuguu

SEQ ID NO: 4463 - RNA, 20 nt, Artificial Sequence
  spacer sequence
auaaaacucauacaacaauc

SEQ ID NO: 4464 - RNA, 20 nt, Artificial Sequence
  spacer sequence
uacaacaaucugagaagugu

SEQ ID NO: 4465 - RNA, 20 nt, Artificial Sequence
  spacer sequence
gagaaguguuuaagcuugau

SEQ ID NO: 4466 - RNA, 20 nt, Artificial Sequence
  spacer sequence
gauuguuguaugaguuuuau

SEQ ID NO: 4467 - RNA, 20 nt, Artificial Sequence
  spacer sequence
cagauuguuguaugaguuuu

SEQ ID NO: 4468 - RNA, 20 nt, Artificial Sequence
  spacer sequence
agcuuaaacacuucucagau

SEQ ID NO: 4469 - RNA, 20 nt, Artificial Sequence
  spacer sequence
gcauguuaucaagcuuaaac

SEQ ID NO: 4470 - RNA, 20 nt, Artificial Sequence
  spacer sequence
uacccaacguucagcauguu

SEQ ID NO: 4471 - RNA, 20 nt, Artificial Sequence
  spacer sequence
acuguucuuacccaacguuc

SEQ ID NO: 4472 - RNA, 20 nt, Artificial Sequence
  spacer sequence
gaagcguucuuuccuaggac

SEQ ID NO: 4473 - RNA, 20 nt, Artificial Sequence
  spacer sequence
gacauccacuguucuuaccc

SEQ ID NO: 4474 - RNA, 20 nt, Artificial Sequence
  spacer sequence
uuccuaggacugcucccauc

SEQ ID NO: 4475 - RNA, 20 nt, Artificial Sequence
  spacer sequence
uaggacugcucccaucuccu

SEQ ID NO: 4476 - RNA, 20 nt, Artificial Sequence
  spacer sequence
uaggaaagaacgcuucagac

SEQ ID NO: 4477 - RNA, 20 nt, Artificial Sequence
  spacer sequence
caucuccucuagccgagugg

SEQ ID NO: 4478 - RNA, 20 nt, Artificial Sequence
  spacer sequence
ccucuagccgagugggugug

SEQ ID NO: 4479 - RNA, 20 nt, Artificial Sequence
  spacer sequence
ucuagccgagugggugugga

SEQ ID NO: 4480 - RNA, 20 nt, Artificial Sequence
  spacer sequence
agccgaguggguguggaggu

SEQ ID NO: 4481 - RNA, 20 nt, Artificial Sequence
  spacer sequence
gcuagaggagaugggagcag

SEQ ID NO: 4482 - RNA, 20 nt, Artificial Sequence
  spacer sequence
acacccacucggcuagagga

SEQ ID NO: 4483 - RNA, 20 nt, Artificial Sequence
  spacer sequence
gccagggcaggaccaggcau

SEQ ID NO: 4484 - RNA, 20 nt, Artificial Sequence
  spacer sequence
ugcccuggcagaaccuccac

SEQ ID NO: 4485 - RNA, 20 nt, Artificial Sequence
  spacer sequence
ugccugguccugcccuggca

SEQ ID NO: 4486 - RNA, 20 nt, Artificial Sequence
  spacer sequence
ucaugccugguccugcccug

SEQ ID NO: 4487 - RNA, 20 nt, Artificial Sequence
  spacer sequence
aaccuggcagcaccacugca

SEQ ID NO: 4488 - RNA, 20 nt, Artificial Sequence
  spacer sequence
aguaagcccccuccaaccug

SEQ ID NO: 4489 - RNA, 20 nt, Artificial Sequence
  spacer sequence
ccugcuacagcaaauccagu

SEQ ID NO: 4490 - RNA, 20 nt, Artificial Sequence
  spacer sequence
guggaagugacaacaguuuu

SEQ ID NO: 4491 - RNA, 20 nt, Artificial Sequence
  spacer sequence
acugacagugccauaggugu

SEQ ID NO: 4492 - RNA, 20 nt, Artificial Sequence
  spacer sequence
cuuccacugacagugccaua

SEQ ID NO: 4493 - RNA, 20 nt, Artificial Sequence
  spacer sequence
agaaacgccauaggaagucc

SEQ ID NO: 4494 - RNA, 20 nt, Artificial Sequence
  spacer sequence
ugaaaggcaaaacuguuguc

SEQ ID NO: 4495 - RNA, 20 nt, Artificial Sequence
  spacer sequence
uauggcguuucuugaaaggc

SEQ ID NO: 4496 - RNA, 20 nt, Artificial Sequence
  spacer sequence
uuuagagugaaagaaagcaa

SEQ ID NO: 4497 - RNA, 20 nt, Artificial Sequence
  spacer sequence
aaaggacuuccuauggcguu

SEQ ID NO: 4498 - RNA, 20 nt, Artificial Sequence
  spacer sequence
cucuaaaggacuuccuaugg

SEQ ID NO: 4499 - RNA, 20 nt, Artificial Sequence
  spacer sequence
uucacucuaaaggacuuccu

SEQ ID NO: 4500 - RNA, 20 nt, Artificial Sequence
  spacer sequence
gagagcaacuuuaaugcaca

SEQ ID NO: 4501 - RNA, 20 nt, Artificial Sequence
  spacer sequence
gauguugcuuucuuucacuc

SEQ ID NO: 4502 - RNA, 20 nt, Artificial Sequence
  spacer sequence
cugauguugcuuucuuucac

SEQ ID NO: 4503 - RNA, 20 nt, Artificial Sequence
  spacer sequence
ugugcauuaaaguugcucuc

SEQ ID NO: 4504 - RNA, 20 nt, Artificial Sequence
  spacer sequence
caccuguaaucccagcacuu

SEQ ID NO: 4505 - RNA, 20 nt, Artificial Sequence
  spacer sequence
cagcacuuugggaggccgag

SEQ ID NO: 4506 - RNA, 20 nt, Artificial Sequence
  spacer sequence
caaagugcugggauuacagg

SEQ ID NO: 4507 - RNA, 20 nt, Artificial Sequence
  spacer sequence
gccucccaaagugcugggau

SEQ ID NO: 4508 - RNA, 20 nt, Artificial Sequence
  spacer sequence
guggaucaugaggucaagag

SEQ ID NO: 4509 - RNA, 20 nt, Artificial Sequence
  spacer sequence
accgaccucggccucccaaa

SEQ ID NO: 4510 - RNA, 20 nt, Artificial Sequence
  spacer sequence
ugaggucaagagaucgagac

SEQ ID NO: 4511 - RNA, 20 nt, Artificial Sequence
  spacer sequence
ugauccaccgaccucggccu

SEQ ID NO: 4512 - RNA, 20 nt, Artificial Sequence
  spacer sequence
agagaucgagacuauccugg

SEQ ID NO: 4513 - RNA, 20 nt, Artificial Sequence
  spacer sequence
ugaccucaugauccaccgac

SEQ ID NO: 4514 - RNA, 20 nt, Artificial Sequence
  spacer sequence
cuugaccucaugauccaccg

SEQ ID NO: 4515 - RNA, 20 nt, Artificial Sequence
  spacer sequence
agacuauccuggccaacaug

SEQ ID NO: 4516 - RNA, 20 nt, Artificial Sequence
  spacer sequence
aucucuugaccucaugaucc

SEQ ID NO: 4517 - RNA, 20 nt, Artificial Sequence
  spacer sequence
cgaucucuugaccucaugau

SEQ ID NO: 4518 - RNA, 20 nt, Artificial Sequence
  spacer sequence
uggccaacauggugaaaucc

SEQ ID NO: 4519 - RNA, 20 nt, Artificial Sequence
  spacer sequence
ccauguuggccaggauaguc

SEQ ID NO: 4520 - RNA, 20 nt, Artificial Sequence
  spacer sequence
caucucucuaaaaauacaaa

SEQ ID NO: 4521 - RNA, 20 nt, Artificial Sequence
  spacer sequence
cucuaaaaauacaaaaauua

SEQ ID NO: 4522 - RNA, 20 nt, Artificial Sequence
  spacer sequence
cuaaaaauacaaaaauuagc

SEQ ID NO: 4523 - RNA, 20 nt, Artificial Sequence
  spacer sequence
aaaaauacaaaaauuagcua

SEQ ID NO: 4524 - RNA, 20 nt, Artificial Sequence
  spacer sequence
cagcuacucgggaagcuggg

SEQ ID NO: 4525 - RNA, 20 nt, Artificial Sequence
  spacer sequence
ggaagcuggggcaggagaau

SEQ ID NO: 4526 - RNA, 20 nt, Artificial Sequence
  spacer sequence
cgaguagcugggacuacagg

SEQ ID NO: 4527 - RNA, 20 nt, Artificial Sequence
  spacer sequence
ugccccagcuucccgaguag

SEQ ID NO: 4528 - RNA, 20 nt, Artificial Sequence
  spacer sequence
ccugccccagcuucccgagu

SEQ ID NO: 4529 - RNA, 20 nt, Artificial Sequence
  spacer sequence
agcaauucuccugccccagc

SEQ ID NO: 4530 - RNA, 20 nt, Artificial Sequence
  spacer sequence
aggaggcagagguugcagug

SEQ ID NO: 4531 - RNA, 20 nt, Artificial Sequence
  spacer sequence
uggauucaagcaauucuccu

SEQ ID NO: 4532 - RNA, 20 nt, Artificial Sequence
  spacer sequence
gccuccuggauucaagcaau

SEQ ID NO: 4533 - RNA, 20 nt, Artificial Sequence
  spacer sequence
cugcaaccucugccuccugg

SEQ ID NO: 4534 - RNA, 20 nt, Artificial Sequence
  spacer sequence
uggcucacugcaaccucugc

SEQ ID NO: 4535 - RNA, 20 nt, Artificial Sequence
  spacer sequence
cgccacugcacuccagccug

SEQ ID NO: 4536 - RNA, 20 nt, Artificial Sequence
  spacer sequence
agccugggcgacagagcgag

SEQ ID NO: 4537 - RNA, 20 nt, Artificial Sequence
  spacer sequence
cccaggcuggagugcagugg

SEQ ID NO: 4538 - RNA, 20 nt, Artificial Sequence
  spacer sequence
gucgcccaggcuggagugca

SEQ ID NO: 4539 - RNA, 20 nt, Artificial Sequence
  spacer sequence
cucugucgcccaggcuggag

SEQ ID NO: 4540 - RNA, 20 nt, Artificial Sequence
  spacer sequence
cgcucugucgcccaggcugg

SEQ ID NO: 4541 - RNA, 20 nt, Artificial Sequence
  spacer sequence
gucaccaaaaaaaaaaaaaa

SEQ ID NO: 4542 - RNA, 20 nt, Artificial Sequence
  spacer sequence
ccaaaaaaaaaaaaaaagaa

SEQ ID NO: 4543 - RNA, 20 nt, Artificial Sequence
  spacer sequence
uuuuuuuuuuuuuuggugac

SEQ ID NO: 4544 - RNA, 20 nt, Artificial Sequence
  spacer sequence
uuucuuuuuuuuuuuuuuug

SEQ ID NO: 4545 - RNA, 20 nt, Artificial Sequence
  spacer sequence
uuuuuucuuuucuuuuuuuu

SEQ ID NO: 4546 - RNA, 20 nt, Artificial Sequence
  spacer sequence
aaugguuuucuuuuuuucuu

SEQ ID NO: 4547 - RNA, 20 nt, Artificial Sequence
  spacer sequence
gcccacauauuuaacaauuc

SEQ ID NO: 4548 - RNA, 20 nt, Artificial Sequence
  spacer sequence
aucagcccacauauuuaaca

SEQ ID NO: 4549 - RNA, 20 nt, Artificial Sequence
  spacer sequence
uuucuaucagcccacauauu

SEQ ID NO: 4550 - RNA, 20 nt, Artificial Sequence
  spacer sequence
auaaauauauuuuucucauu

SEQ ID NO: 4551 - RNA, 20 nt, Artificial Sequence
  spacer sequence
cauuucuucuguuaccuuuu

SEQ ID NO: 4552 - RNA, 20 nt, Artificial Sequence
  spacer sequence
uuucuucuguuaccuuuuaa

SEQ ID NO: 4553 - RNA, 20 nt, Artificial Sequence
  spacer sequence
ucuguuaccuuuuaaaaaag

SEQ ID NO: 4554 - RNA, 20 nt, Artificial Sequence
  spacer sequence
guuaccuuuuaaaaaaggca

SEQ ID NO: 4555 - RNA, 20 nt, Artificial Sequence
  spacer sequence
uauguauuacauuuauacau

SEQ ID NO: 4556 - RNA, 20 nt, Artificial Sequence
  spacer sequence
uuuuuguauuaucauaugua

SEQ ID NO: 4557 - RNA, 20 nt, Artificial Sequence
  spacer sequence
cucuuuuuuguauuaucaua

SEQ ID NO: 4558 - RNA, 20 nt, Artificial Sequence
  spacer sequence
ucccucuuuuuuguauuauc

SEQ ID NO: 4559 - RNA, 20 nt, Artificial Sequence
  spacer sequence
cuucccucuuuuuuguauua

SEQ ID NO: 4560 - RNA, 20 nt, Artificial Sequence
  spacer sequence
auucucuucccucuuuuuug

SEQ ID NO: 4561 - RNA, 20 nt, Artificial Sequence
  spacer sequence
auguuuuaucugaauuaaau

SEQ ID NO: 4562 - RNA, 20 nt, Artificial Sequence
  spacer sequence
gaauuaaauuaguaauaauc

SEQ ID NO: 4563 - RNA, 20 nt, Artificial Sequence
  spacer sequence
gauaaaacauagaaauuuug

SEQ ID NO: 4564 - RNA, 20 nt, Artificial Sequence
  spacer sequence
gaacuauauuuagauaagau

SEQ ID NO: 4565 - RNA, 20 nt, Artificial Sequence
  spacer sequence
gauuauuacuaauuuaauuc

SEQ ID NO: 4566 - RNA, 20 nt, Artificial Sequence
  spacer sequence
aaauauaguucagauuauua

SEQ ID NO: 4567 - RNA, 20 nt, Artificial Sequence
  spacer sequence
uaucuaaauauaguucagau

SEQ ID NO: 4568 - RNA, 20 nt, Artificial Sequence
  spacer sequence
aaauaucaaguuguaccccu

SEQ ID NO: 4569 - RNA, 20 nt, Artificial Sequence
  spacer sequence
aguuguaccccuuaaauaua

SEQ ID NO: 4570 - RNA, 20 nt, Artificial Sequence
  spacer sequence
auuauaccucaauaaagcug

SEQ ID NO: 4571 - RNA, 20 nt, Artificial Sequence
  spacer sequence
auaaagcugaaaaaauuacu

SEQ ID NO: 4572 - RNA, 20 nt, Artificial Sequence
  spacer sequence
gcuuuauugagguauaauug

SEQ ID NO: 4573 - RNA, 20 nt, Artificial Sequence
  spacer sequence
aaguaauuuuuucagcuuua

SEQ ID NO: 4574 - RNA, 20 nt, Artificial Sequence
  spacer sequence
caaaguaauuuuuucagcuu

SEQ ID NO: 4575 - RNA, 20 nt, Artificial Sequence
  spacer sequence
uauuaaaaaauacauauugu

SEQ ID NO: 4576 - RNA, 20 nt, Artificial Sequence
  spacer sequence
auacugcaaugacuaagaaa

SEQ ID NO: 4577 - RNA, 20 nt, Artificial Sequence
  spacer sequence
uugcaguauggauuacaaua

SEQ ID NO: 4578 - RNA, 20 nt, Artificial Sequence
  spacer sequence
uagucauugcaguauggauu

SEQ ID NO: 4579 - RNA, 20 nt, Artificial Sequence
  spacer sequence
uuuuuuaacuauuuaaaaau

SEQ ID NO: 4580 - RNA, 20 nt, Artificial Sequence
  spacer sequence
guguuacauauuuuuuagua

SEQ ID NO: 4581 - RNA, 20 nt, Artificial Sequence
  spacer sequence
gugaaagaggggcagagaaa

SEQ ID NO: 4582 - RNA, 20 nt, Artificial Sequence
  spacer sequence
cugauuucuguguuacauau

SEQ ID NO: 4583 - RNA, 20 nt, Artificial Sequence
  spacer sequence
uucacugauuucuguguuac

SEQ ID NO: 4584 - RNA, 20 nt, Artificial Sequence
  spacer sequence
gccccucuuucacugauuuc

SEQ ID NO: 4585 - RNA, 20 nt, Artificial Sequence
  spacer sequence
cugccccucuuucacugauu

SEQ ID NO: 4586 - RNA, 20 nt, Artificial Sequence
  spacer sequence
uauuuuuguuucucugcccc

SEQ ID NO: 4587 - RNA, 20 nt, Artificial Sequence
  spacer sequence
ccuauuuuuguuucucugcc

SEQ ID NO: 4588 - RNA, 20 nt, Artificial Sequence
  spacer sequence
auaugucuccuauuuuuguu

SEQ ID NO: 4589 - RNA, 20 nt, Artificial Sequence
  spacer sequence
ugccugcaaugcuaguauuu

SEQ ID NO: 4590 - RNA, 20 nt, Artificial Sequence
  spacer sequence
caaaauacuagcauugcagg

SEQ ID NO: 4591 - RNA, 20 nt, Artificial Sequence
  spacer sequence
gccucccaaaauacuagcau

SEQ ID NO: 4592 - RNA, 20 nt, Artificial Sequence
  spacer sequence
ccucagccucccaaaauacu

SEQ ID NO: 4593 - RNA, 20 nt, Artificial Sequence
  spacer sequence
caccucagccucccaaaaua

SEQ ID NO: 4594 - RNA, 20 nt, Artificial Sequence
  spacer sequence
ucucaccucagccucccaaa

SEQ ID NO: 4595 - RNA, 20 nt, Artificial Sequence
  spacer sequence
agcaaucuucucaccucagc

SEQ ID NO: 4596 - RNA, 20 nt, Artificial Sequence
  spacer sequence
ggaauucaagaccagacugg

SEQ ID NO: 4597 - RNA, 20 nt, Artificial Sequence
  spacer sequence
ugagcucaagcaaucuucuc

SEQ ID NO: 4598 - RNA, 20 nt, Artificial Sequence
  spacer sequence
agaccagacugggcaacaua

SEQ ID NO: 4599 - RNA, 20 nt, Artificial Sequence
  spacer sequence
ugaauuccugagcucaagca

SEQ ID NO: 4600 - RNA, 20 nt, Artificial Sequence
  spacer sequence
ggucuugaauuccugagcuc

SEQ ID NO: 4601 - RNA, 20 nt, Artificial Sequence
  spacer sequence
uuauguugcccagucugguc

SEQ ID NO: 4602 - RNA, 20 nt, Artificial Sequence
  spacer sequence
cauuauguugcccagucugg

SEQ ID NO: 4603 - RNA, 20 nt, Artificial Sequence
  spacer sequence
cuauaaaauuauacaaagaa

SEQ ID NO: 4604 - RNA, 20 nt, Artificial Sequence
  spacer sequence
auaaaauuauacaaagaaaa

SEQ ID NO: 4605 - RNA, 20 nt, Artificial Sequence
  spacer sequence
uuguauaauuuuauagagau

SEQ ID NO: 4606 - RNA, 20 nt, Artificial Sequence
  spacer sequence
uagcuacuugggaggcuaag

SEQ ID NO: 4607 - RNA, 20 nt, Artificial Sequence
  spacer sequence
caaguagcuaggacuacagg

SEQ ID NO: 4608 - RNA, 20 nt, Artificial Sequence
  spacer sequence
uagccucccaaguagcuagg

SEQ ID NO: 4609 - RNA, 20 nt, Artificial Sequence
  spacer sequence
caucuuagccucccaaguag

SEQ ID NO: 4610 - RNA, 20 nt, Artificial Sequence
  spacer sequence
ucccaucuuagccucccaag

SEQ ID NO: 4611 - RNA, 20 nt, Artificial Sequence
  spacer sequence
cuugagcccaggaguucgag

SEQ ID NO: 4612 - RNA, 20 nt, Artificial Sequence
  spacer sequence
ugagcccaggaguucgaggc

SEQ ID NO: 4613 - RNA, 20 nt, Artificial Sequence
  spacer sequence
agagaucuucccaucuuagc

SEQ ID NO: 4614 - RNA, 20 nt, Artificial Sequence
  spacer sequence
ugggcucaagagaucuuccc

SEQ ID NO: 4615 - RNA, 20 nt, Artificial Sequence
  spacer sequence
aggcugcagugagcugugau

SEQ ID NO: 4616 - RNA, 20 nt, Artificial Sequence
  spacer sequence
aacuccugggcucaagagau

SEQ ID NO: 4617 - RNA, 20 nt, Artificial Sequence
  spacer sequence
cugcagccucgaacuccugg

SEQ ID NO: 4618 - RNA, 20 nt, Artificial Sequence
  spacer sequence
cagcucacugcagccucgaa

SEQ ID NO: 4619 - RNA, 20 nt, Artificial Sequence
  spacer sequence
cgucacugcacuuuagccug

SEQ ID NO: 4620 - RNA, 20 nt, Artificial Sequence
  spacer sequence
cugcacuuuagccugggcua

SEQ ID NO: 4621 - RNA, 20 nt, Artificial Sequence
  spacer sequence
auagcccaggcuaaagugca

SEQ ID NO: 4622 - RNA, 20 nt, Artificial Sequence
  spacer sequence
uucuauagcccaggcuaaag

SEQ ID NO: 4623 - RNA, 20 nt, Artificial Sequence
  spacer sequence
cauucuauagcccaggcuaa

SEQ ID NO: 4624 - RNA, 20 nt, Artificial Sequence
  spacer sequence
aaaauaauaaaaaauaaaaa

SEQ ID NO: 4625 - RNA, 20 nt, Artificial Sequence
  spacer sequence
uuuuuuuuuuuauuuuuuau

SEQ ID NO: 4626 - RNA, 20 nt, Artificial Sequence
  spacer sequence
uuuguuguugcuuaauuuac

SEQ ID NO: 4627 - RNA, 20 nt, Artificial Sequence
  spacer sequence
aaacuuauuaauuacauuaa

SEQ ID NO: 4628 - RNA, 20 nt, Artificial Sequence
  spacer sequence
cauuuaauguaauuaauaag

SEQ ID NO: 4629 - RNA, 20 nt, Artificial Sequence
  spacer sequence
aaacauuccaauaaaaaaca

SEQ ID NO: 4630 - RNA, 20 nt, Artificial Sequence
  spacer sequence
aauaaaaaacaagauauuug

SEQ ID NO: 4631 - RNA, 20 nt, Artificial Sequence
  spacer sequence
uguuuuuuauuggaauguuu

SEQ ID NO: 4632 - RNA, 20 nt, Artificial Sequence
  spacer sequence
aaauaucuuguuuuuuauug

SEQ ID NO: 4633 - RNA, 20 nt, Artificial Sequence
  spacer sequence
aauccaaauaucuuguuuuu

SEQ ID NO: 4634 - RNA, 20 nt, Artificial Sequence
  spacer sequence
aacuauaggcagucugcaag

SEQ ID NO: 4635 - RNA, 20 nt, Artificial Sequence
  spacer sequence
gcaagaguuacaccuuaggu

SEQ ID NO: 4636 - RNA, 20 nt, Artificial Sequence
  spacer sequence
ugcagacugccuauaguuag

SEQ ID NO: 4637 - RNA, 20 nt, Artificial Sequence
  spacer sequence
aagacacaaauagguggaaa

SEQ ID NO: 4638 - RNA, 20 nt, Artificial Sequence
  spacer sequence
uugaaccuaagguguaacuc

SEQ ID NO: 4639 - RNA, 20 nt, Artificial Sequence
  spacer sequence
accuauuugugucuuugaac

SEQ ID NO: 4640 - RNA, 20 nt, Artificial Sequence
  spacer sequence
auguuuuuacuuuccaccua

SEQ ID NO: 4641 - RNA, 20 nt, Artificial Sequence
  spacer sequence
uuuuccauguuuuuacuuuc

SEQ ID NO: 4642 - RNA, 20 nt, Artificial Sequence
  spacer sequence
uagcauaucuuuuuccaugu

SEQ ID NO: 4643 - RNA, 20 nt, Artificial Sequence
  spacer sequence
agccuacuauuuucauagca

SEQ ID NO: 4644 - RNA, 20 nt, Artificial Sequence
  spacer sequence
aaaauccuagcacuuuggga

SEQ ID NO: 4645 - RNA, 20 nt, Artificial Sequence
  spacer sequence
uagcacuuugggaggccaag

SEQ ID NO: 4646 - RNA, 20 nt, Artificial Sequence
  spacer sequence
caaagugcuaggauuuuaga

SEQ ID NO: 4647 - RNA, 20 nt, Artificial Sequence
  spacer sequence
caccuuggccucccaaagug

SEQ ID NO: 4648 - RNA, 20 nt, Artificial Sequence
  spacer sequence
ucccaccuuggccucccaaa

SEQ ID NO: 4649 - RNA, 20 nt, Artificial Sequence
  spacer sequence
agcaguccucccaccuuggc

SEQ ID NO: 4650 - RNA, 20 nt, Artificial Sequence
  spacer sequence
ggaguuuaagaucaaccugg

SEQ ID NO: 4651 - RNA, 20 nt, Artificial Sequence
  spacer sequence
ugagcucaagcaguccuccc

SEQ ID NO: 4652 - RNA, 20 nt, Artificial Sequence
  spacer sequence
uaaacuccugagcucaagca

SEQ ID NO: 4653 - RNA, 20 nt, Artificial Sequence
  spacer sequence
accugggcaauacagcaaaa

SEQ ID NO: 4654 - RNA, 20 nt, Artificial Sequence
  spacer sequence
cuacaaaaaauacaaaaauu

SEQ ID NO: 4655 - RNA, 20 nt, Artificial Sequence
  spacer sequence
acaaaaaauacaaaaauuag

SEQ ID NO: 4656 - RNA, 20 nt, Artificial Sequence
  spacer sequence
cagcuacucagagacugagg

SEQ ID NO: 4657 - RNA, 20 nt, Artificial Sequence
  spacer sequence
gagacugaggugcgaagauc

SEQ ID NO: 4658 - RNA, 20 nt, Artificial Sequence
  spacer sequence
gaguagcugggacuacaggc

SEQ ID NO: 4659 - RNA, 20 nt, Artificial Sequence
  spacer sequence
cugaguagcugggacuacag

SEQ ID NO: 4660 - RNA, 20 nt, Artificial Sequence
  spacer sequence
gucucugaguagcugggacu

SEQ ID NO: 4661 - RNA, 20 nt, Artificial Sequence
  spacer sequence
caccucagucucugaguagc

SEQ ID NO: 4662 - RNA, 20 nt, Artificial Sequence
  spacer sequence
ucgcaccucagucucugagu

SEQ ID NO: 4663 - RNA, 20 nt, Artificial Sequence
  spacer sequence
uugagccucagagaucaagg

SEQ ID NO: 4664 - RNA, 20 nt, Artificial Sequence
  spacer sequence
aggaucuucgcaccucaguc

SEQ ID NO: 4665 - RNA, 20 nt, Artificial Sequence
  spacer sequence
gagaucaaggcugcagugag

SEQ ID NO: 4666 - RNA, 20 nt, Artificial Sequence
  spacer sequence
gaggcucaaggaucuucgca

SEQ ID NO: 4667 - RNA, 20 nt, Artificial Sequence
  spacer sequence
cugaggcucaaggaucuucg

SEQ ID NO: 4668 - RNA, 20 nt, Artificial Sequence
  spacer sequence
aggcugcagugagccguaau

SEQ ID NO: 4669 - RNA, 20 nt, Artificial Sequence
  spacer sequence
cugcagccuugaucucugag

SEQ ID NO: 4670 - RNA, 20 nt, Artificial Sequence
  spacer sequence
cccaggcuguagugcagugg

SEQ ID NO: 4671 - RNA, 20 nt, Artificial Sequence
  spacer sequence
gucacccaggcuguagugca

SEQ ID NO: 4672 - RNA, 20 nt, Artificial Sequence
  spacer sequence
cugucacccaggcuguagug

SEQ ID NO: 4673 - RNA, 20 nt, Artificial Sequence
  spacer sequence
gucucugucacccaggcugu

SEQ ID NO: 4674 - RNA, 20 nt, Artificial Sequence
  spacer sequence
cucugucucugucacccagg

SEQ ID NO: 4675 - RNA, 20 nt, Artificial Sequence
  spacer sequence
cacucugucucugucaccca

SEQ ID NO: 4676 - RNA, 20 nt, Artificial Sequence
  spacer sequence
caaaaaaaaaaaaaaaaaag

SEQ ID NO: 4677 - RNA, 20 nt, Artificial Sequence
  spacer sequence
aaaaaaaaaaaaaaaaagua

SEQ ID NO: 4678 - RNA, 20 nt, Artificial Sequence
  spacer sequence
uaugguuacuuuuuuuuuuu

SEQ ID NO: 4679 - RNA, 20 nt, Artificial Sequence
  spacer sequence
cuuaugguuacuuuuuuuuu

SEQ ID NO: 4680 - RNA, 20 nt, Artificial Sequence
  spacer sequence
uuaguuauguggcuaucagc

SEQ ID NO: 4681 - RNA, 20 nt, Artificial Sequence
  spacer sequence
gcuaacauaaacuuuaaguc

SEQ ID NO: 4682 - RNA, 20 nt, Artificial Sequence
  spacer sequence
agaaauauuacuggagacaa

SEQ ID NO: 4683 - RNA, 20 nt, Artificial Sequence
  spacer sequence
ugacuuaaaguuuauguuag

SEQ ID NO: 4684 - RNA, 20 nt, Artificial Sequence
  spacer sequence
aguaauauuucuugacuuaa

SEQ ID NO: 4685 - RNA, 20 nt, Artificial Sequence
  spacer sequence
ccaguaauauuucuugacuu

SEQ ID NO: 4686 - RNA, 20 nt, Artificial Sequence
  spacer sequence
uugucuccaguaauauuucu

SEQ ID NO: 4687 - RNA, 20 nt, Artificial Sequence
  spacer sequence
ucguugucuccaguaauauu

SEQ ID NO: 4688 - RNA, 20 nt, Artificial Sequence
  spacer sequence
uuacuaaauguuccucguug

SEQ ID NO: 4689 - RNA, 20 nt, Artificial Sequence
  spacer sequence
uuuaucauuacuaaauguuc

SEQ ID NO: 4690 - RNA, 20 nt, Artificial Sequence
  spacer sequence
auaugucaggaauguacaag

SEQ ID NO: 4691 - RNA, 20 nt, Artificial Sequence
  spacer sequence
ggaauguacaagucauaaau

SEQ ID NO: 4692 - RNA, 20 nt, Artificial Sequence
  spacer sequence
ugacauauugacucuuuuau

SEQ ID NO: 4693 - RNA, 20 nt, Artificial Sequence
  spacer sequence
uaaauauguacaucgcuaau

SEQ ID NO: 4694 - RNA, 20 nt, Artificial Sequence
  spacer sequence
cuaauaaagccucaaaaaca

SEQ ID NO: 4695 - RNA, 20 nt, Artificial Sequence
  spacer sequence
aaaacaugaaacaaaacugg

SEQ ID NO: 4696 - RNA, 20 nt, Artificial Sequence
  spacer sequence
uguuuuugaggcuuuauuag

SEQ ID NO: 4697 - RNA, 20 nt, Artificial Sequence
  spacer sequence
gccaguuuuguuucauguuu

SEQ ID NO: 4698 - RNA, 20 nt, Artificial Sequence
  spacer sequence
uuuaauucugccaguuuugu

SEQ ID NO: 4699 - RNA, 20 nt, Artificial Sequence
  spacer sequence
cuuuuaauucugccaguuuu

SEQ ID NO: 4700 - RNA, 20 nt, Artificial Sequence
  spacer sequence
uauaucucuuuuaauucugc

SEQ ID NO: 4701 - RNA, 20 nt, Artificial Sequence
  spacer sequence
ucuuauaucucuuuuaauuc

SEQ ID NO: 4702 - RNA, 20 nt, Artificial Sequence
  spacer sequence
auaucuucuuauaucucuuu

SEQ ID NO: 4703 - RNA, 20 nt, Artificial Sequence
  spacer sequence
acaacaauaguugaggauau

SEQ ID NO: 4704 - RNA, 20 nt, Artificial Sequence
  spacer sequence
acuauuguuguugaacuguc

SEQ ID NO: 4705 - RNA, 20 nt, Artificial Sequence
  spacer sequence
ucaacuauuguuguugaacu

SEQ ID NO: 4706 - RNA, 20 nt, Artificial Sequence
  spacer sequence
auauucuauucuaauugaug

SEQ ID NO: 4707 - RNA, 20 nt, Artificial Sequence
  spacer sequence
auucuaauugaugaaaaaau

SEQ ID NO: 4708 - RNA, 20 nt, Artificial Sequence
  spacer sequence
aauugaugaaaaaauuagac

SEQ ID NO: 4709 - RNA, 20 nt, Artificial Sequence
  spacer sequence
auuagaauagaauauugaua

SEQ ID NO: 4710 - RNA, 20 nt, Artificial Sequence
  spacer sequence
ucaauuagaauagaauauug

SEQ ID NO: 4711 - RNA, 20 nt, Artificial Sequence
  spacer sequence
aauuuuuucaucaauuagaa

SEQ ID NO: 4712 - RNA, 20 nt, Artificial Sequence
  spacer sequence
gcaaggauauuaaagaguua

SEQ ID NO: 4713 - RNA, 20 nt, Artificial Sequence
  spacer sequence
uugcugauuuauugucuaau

SEQ ID NO: 4714 - RNA, 20 nt, Artificial Sequence
  spacer sequence
uuaauauccuugcugauuua

SEQ ID NO: 4715 - RNA, 20 nt, Artificial Sequence
  spacer sequence
aacucuuuaauauccuugcu

SEQ ID NO: 4716 - RNA, 20 nt, Artificial Sequence
  spacer sequence
cauagguuaauaauguuuuc

SEQ ID NO: 4717 - RNA, 20 nt, Artificial Sequence
  spacer sequence
auuaggucacauagguuaau

SEQ ID NO: 4718 - RNA, 20 nt, Artificial Sequence
  spacer sequence
aaugagucucaacucauuca

SEQ ID NO: 4719 - RNA, 20 nt, Artificial Sequence
  spacer sequence
uuggacauauaucaauuagg

SEQ ID NO: 4720 - RNA, 20 nt, Artificial Sequence
  spacer sequence
caacucauucagugagaaca

SEQ ID NO: 4721 - RNA, 20 nt, Artificial Sequence
  spacer sequence
acucauucagugagaacagu

SEQ ID NO: 4722 - RNA, 20 nt, Artificial Sequence
  spacer sequence
uucagugagaacaguuaaua

SEQ ID NO: 4723 - RNA, 20 nt, Artificial Sequence
  spacer sequence
gugagaacaguuaauaaaga

SEQ ID NO: 4724 - RNA, 20 nt, Artificial Sequence
  spacer sequence
cugaaugaguugagacucau

SEQ ID NO: 4725 - RNA, 20 nt, Artificial Sequence
  spacer sequence
cacugaaugaguugagacuc

SEQ ID NO: 4726 - RNA, 20 nt, Artificial Sequence
  spacer sequence
uuauuaacuguucucacuga

SEQ ID NO: 4727 - RNA, 20 nt, Artificial Sequence
  spacer sequence
gguaauaaaaaugucuuuau

SEQ ID NO: 4728 - RNA, 20 nt, Artificial Sequence
  spacer sequence
guaauuuuauuuucugguaa

SEQ ID NO: 4729 - RNA, 20 nt, Artificial Sequence
  spacer sequence
cuuaacaaaauauuaauaca

SEQ ID NO: 4730 - RNA, 20 nt, Artificial Sequence
  spacer sequence
gcaacauauauaaaggauua

SEQ ID NO: 4731 - RNA, 20 nt, Artificial Sequence
  spacer sequence
uuuauauauguugcagaauu

SEQ ID NO: 4732 - RNA, 20 nt, Artificial Sequence
  spacer sequence
gaacaagugggauuuauuau

SEQ ID NO: 4733 - RNA, 20 nt, Artificial Sequence
  spacer sequence
gaguauauaauccuuuauau

SEQ ID NO: 4734 - RNA, 20 nt, Artificial Sequence
  spacer sequence
cacuuguucagaguauauaa

SEQ ID NO: 4735 - RNA, 20 nt, Artificial Sequence
  spacer sequence
uauaauaaaucccacuuguu

SEQ ID NO: 4736 - RNA, 20 nt, Artificial Sequence
  spacer sequence
agguugguuaacgucugaaa

SEQ ID NO: 4737 - RNA, 20 nt, Artificial Sequence
  spacer sequence
gaaacuugaccaguguaaua

SEQ ID NO: 4738 - RNA, 20 nt, Artificial Sequence
  spacer sequence
gacguuaaccaaccuugaau

SEQ ID NO: 4739 - RNA, 20 nt, Artificial Sequence
  spacer sequence
aguuucagacguuaaccaac

SEQ ID NO: 4740 - RNA, 20 nt, Artificial Sequence
  spacer sequence
guauaguauauuacacuggu

SEQ ID NO: 4741 - RNA, 20 nt, Artificial Sequence
  spacer sequence
aucaguauaguauauuacac

SEQ ID NO: 4742 - RNA, 20 nt, Artificial Sequence
  spacer sequence
uuuguucuaucaguauagua

SEQ ID NO: 4743 - RNA, 20 nt, Artificial Sequence
  spacer sequence
uguaguuuuuguccuuuguu

SEQ ID NO: 4744 - RNA, 20 nt, Artificial Sequence
  spacer sequence
ucucaauaauagaugcagaa

SEQ ID NO: 4745 - RNA, 20 nt, Artificial Sequence
  spacer sequence
caauaauagaugcagaaaua

SEQ ID NO: 4746 - RNA, 20 nt, Artificial Sequence
  spacer sequence
auaauagaugcagaaauacc

SEQ ID NO: 4747 - RNA, 20 nt, Artificial Sequence
  spacer sequence
auuauugagaggaucaugua

SEQ ID NO: 4748 - RNA, 20 nt, Artificial Sequence
  spacer sequence
gcaucuauuauugagaggau

SEQ ID NO: 4749 - RNA, 20 nt, Artificial Sequence
  spacer sequence
aacaaaaucuaacacucuuu

SEQ ID NO: 4750 - RNA, 20 nt, Artificial Sequence
  spacer sequence
aacacucuuucauguuaaaa

SEQ ID NO: 4751 - RNA, 20 nt, Artificial Sequence
  spacer sequence
uucauguuaaaaacucucaa

SEQ ID NO: 4752 - RNA, 20 nt, Artificial Sequence
  spacer sequence
uguuaaaaacucucaacaaa

SEQ ID NO: 4753 - RNA, 20 nt, Artificial Sequence
  spacer sequence
caacaaacuaggaauagaug

SEQ ID NO: 4754 - RNA, 20 nt, Artificial Sequence
  spacer sequence
acaaacuaggaauagauggg

SEQ ID NO: 4755 - RNA, 20 nt, Artificial Sequence
  spacer sequence
uaguuuguugagaguuuuua

SEQ ID NO: 4756 - RNA, 20 nt, Artificial Sequence
  spacer sequence
auuccuaguuuguugagagu

SEQ ID NO: 4757 - RNA, 20 nt, Artificial Sequence
  spacer sequence
caucuauuccuaguuuguug

SEQ ID NO: 4758 - RNA, 20 nt, Artificial Sequence
  spacer sequence
ucaaccuggauaaagugcau

SEQ ID NO: 4759 - RNA, 20 nt, Artificial Sequence
  spacer sequence
accuggauaaagugcaucua

SEQ ID NO: 4760 - RNA, 20 nt, Artificial Sequence
  spacer sequence
agguugaggaaguucccauc

SEQ ID NO: 4761 - RNA, 20 nt, Artificial Sequence
  spacer sequence
augaaacacccacaguuaac

SEQ ID NO: 4762 - RNA, 20 nt, Artificial Sequence
  spacer sequence
uagaugcacuuuauccaggu

SEQ ID NO: 4763 - RNA, 20 nt, Artificial Sequence
  spacer sequence
uacuuaacaguaaaagacug

SEQ ID NO: 4764 - RNA, 20 nt, Artificial Sequence
  spacer sequence
uuuacuguuaaguaugaugu

SEQ ID NO: 4765 - RNA, 20 nt, Artificial Sequence
  spacer sequence
gucuuuuacuguuaaguaug

SEQ ID NO: 4766 - RNA, 20 nt, Artificial Sequence
  spacer sequence
cugaaaugucaggaacaaug

SEQ ID NO: 4767 - RNA, 20 nt, Artificial Sequence
  spacer sequence
gggaaauguucagucuuuua

SEQ ID NO: 4768 - RNA, 20 nt, Artificial Sequence
  spacer sequence
ggaacaaugcaaaaugucag

SEQ ID NO: 4769 - RNA, 20 nt, Artificial Sequence
  spacer sequence
ugacauuucagggaaauguu

SEQ ID NO: 4770 - RNA, 20 nt, Artificial Sequence
  spacer sequence
guucuugcuacuucuauuca

SEQ ID NO: 4771 - RNA, 20 nt, Artificial Sequence
  spacer sequence
ugcuacuucuauucaacacu

SEQ ID NO: 4772 - RNA, 20 nt, Artificial Sequence
  spacer sequence
auucaacacugcccuggggg

SEQ ID NO: 4773 - RNA, 20 nt, Artificial Sequence
  spacer sequence
acacugcccuggggguccca

SEQ ID NO: 4774 - RNA, 20 nt, Artificial Sequence
  spacer sequence
cagacaguguuauaaggcca

SEQ ID NO: 4775 - RNA, 20 nt, Artificial Sequence
  spacer sequence
gggacccccagggcaguguu

SEQ ID NO: 4776 - RNA, 20 nt, Artificial Sequence
  spacer sequence
uuauggccuuauaacacugu

SEQ ID NO: 4777 - RNA, 20 nt, Artificial Sequence
  spacer sequence
ucuuuauggccuuauaacac

SEQ ID NO: 4778 - RNA, 20 nt, Artificial Sequence
  spacer sequence
uuuuucaucuuuauggccuu

SEQ ID NO: 4779 - RNA, 20 nt, Artificial Sequence
  spacer sequence
gucuuuuuucaucuuuaugg

SEQ ID NO: 4780 - RNA, 20 nt, Artificial Sequence
  spacer sequence
acuucagucuuuuuucaucu

SEQ ID NO: 4781 - RNA, 20 nt, Artificial Sequence
  spacer sequence
uuaaagaagauauacaaauu

SEQ ID NO: 4782 - RNA, 20 nt, Artificial Sequence
  spacer sequence
uuaaugaaauguccacuuca

SEQ ID NO: 4783 - RNA, 20 nt, Artificial Sequence
  spacer sequence
ucuuuaaugaaauguccacu

SEQ ID NO: 4784 - RNA, 20 nt, Artificial Sequence
  spacer sequence
gcauuaugauaaggugcuca

SEQ ID NO: 4785 - RNA, 20 nt, Artificial Sequence
  spacer sequence
uaaugcugauuagcaauuug

SEQ ID NO: 4786 - RNA, 20 nt, Artificial Sequence
  spacer sequence
acaucauuagucauuagaaa

SEQ ID NO: 4787 - RNA, 20 nt, Artificial Sequence
  spacer sequence
uuagucauuagaaaaaugca

SEQ ID NO: 4788 - RNA, 20 nt, Artificial Sequence
  spacer sequence
uuagaaaaaugcaaauuacg

SEQ ID NO: 4789 - RNA, 20 nt, Artificial Sequence
  spacer sequence
aaugacuaaugauguugagc

SEQ ID NO: 4790 - RNA, 20 nt, Artificial Sequence
  spacer sequence
uuguaaccguaauuugcauu

SEQ ID NO: 4791 - RNA, 20 nt, Artificial Sequence
  spacer sequence
uuagaauggcuguaaucaaa

SEQ ID NO: 4792 - RNA, 20 nt, Artificial Sequence
  spacer sequence
aaugaacguauaguaguauu

SEQ ID NO: 4793 - RNA, 20 nt, Artificial Sequence
  spacer sequence
aaaaagaaaaacaauaccaa

SEQ ID NO: 4794 - RNA, 20 nt, Artificial Sequence
  spacer sequence
uuuuugauuacagccauucu

SEQ ID NO: 4795 - RNA, 20 nt, Artificial Sequence
  spacer sequence
ccaacacuugguauuguuuu

SEQ ID NO: 4796 - RNA, 20 nt, Artificial Sequence
  spacer sequence
ucaccaacacuugguauugu

SEQ ID NO: 4797 - RNA, 20 nt, Artificial Sequence
  spacer sequence
ccauccucaccaacacuugg

SEQ ID NO: 4798 - RNA, 20 nt, Artificial Sequence
  spacer sequence
ccccauccucaccaacacuu

SEQ ID NO: 4799 - RNA, 20 nt, Artificial Sequence
  spacer sequence
auuuucuccccauccucacc

SEQ ID NO: 4800 - RNA, 20 nt, Artificial Sequence
  spacer sequence
uacguugcugauggaaaugu

SEQ ID NO: 4801 - RNA, 20 nt, Artificial Sequence
  spacer sequence
gcaacguaugaugguuccau

SEQ ID NO: 4802 - RNA, 20 nt, Artificial Sequence
  spacer sequence
aucagcaacguaugaugguu

SEQ ID NO: 4803 - RNA, 20 nt, Artificial Sequence
  spacer sequence
cuuuacauuuccaucagcaa

SEQ ID NO: 4804 - RNA, 20 nt, Artificial Sequence
  spacer sequence
acaucacuuuacauuuccau

SEQ ID NO: 4805 - RNA, 20 nt, Artificial Sequence
  spacer sequence
aagugucuacaucacuuuac

SEQ ID NO: 4806 - RNA, 20 nt, Artificial Sequence
  spacer sequence
uugguuuuuuaacuuuuguu

SEQ ID NO: 4807 - RNA, 20 nt, Artificial Sequence
  spacer sequence
cuuugguuuuuuaacuuuug

SEQ ID NO: 4808 - RNA, 20 nt, Artificial Sequence
  spacer sequence
gaggcaugaaugccaguguu

SEQ ID NO: 4809 - RNA, 20 nt, Artificial Sequence
  spacer sequence
gaacacauaugguuuuauuu

SEQ ID NO: 4810 - RNA, 20 nt, Artificial Sequence
  spacer sequence
ugccucugaacacauauggu

SEQ ID NO: 4811 - RNA, 20 nt, Artificial Sequence
  spacer sequence
uaauauucaagaacuggaaa

SEQ ID NO: 4812 - RNA, 20 nt, Artificial Sequence
  spacer sequence
agaacuggaaauacuccugu

SEQ ID NO: 4813 - RNA, 20 nt, Artificial Sequence
  spacer sequence
ugaauauuaugaauaaugcu

SEQ ID NO: 4814 - RNA, 20 nt, Artificial Sequence
  spacer sequence
aguucuugaauauuaugaau

SEQ ID NO: 4815 - RNA, 20 nt, Artificial Sequence
  spacer sequence
uguaugccugucuaaggcug

SEQ ID NO: 4816 - RNA, 20 nt, Artificial Sequence
  spacer sequence
aaggcuguuguaacaaacua

SEQ ID NO: 4817 - RNA, 20 nt, Artificial Sequence
  spacer sequence
agccgugugcaugguaguuu

SEQ ID NO: 4818 - RNA, 20 nt, Artificial Sequence
  spacer sequence
uaccuguaaucucagcacuu

SEQ ID NO: 4819 - RNA, 20 nt, Artificial Sequence
  spacer sequence
cagcacuuugggaagccgag

SEQ ID NO: 4820 - RNA, 20 nt, Artificial Sequence
  spacer sequence
gcacuuugggaagccgagga

SEQ ID NO: 4821 - RNA, 20 nt, Artificial Sequence
  spacer sequence
caaagugcugagauuacagg

SEQ ID NO: 4822 - RNA, 20 nt, Artificial Sequence
  spacer sequence
gcuucccaaagugcugagau

SEQ ID NO: 4823 - RNA, 20 nt, Artificial Sequence
  spacer sequence
ucggcuucccaaagugcuga

SEQ ID NO: 4824 - RNA, 20 nt, Artificial Sequence
  spacer sequence
accuccucggcuucccaaag

SEQ ID NO: 4825 - RNA, 20 nt, Artificial Sequence
  spacer sequence
ccugaggucaggagauugag

SEQ ID NO: 4826 - RNA, 20 nt, Artificial Sequence
  spacer sequence
ggugauccaccuccucggcu

SEQ ID NO: 4827 - RNA, 20 nt, Artificial Sequence
  spacer sequence
ggagauugagaccagccugg

SEQ ID NO: 4828 - RNA, 20 nt, Artificial Sequence
  spacer sequence
ugaccucaggugauccaccu

SEQ ID NO: 4829 - RNA, 20 nt, Artificial Sequence
  spacer sequence
ccugaccucaggugauccac

SEQ ID NO: 4830 - RNA, 20 nt, Artificial Sequence
  spacer sequence
aucuccugaccucaggugau

SEQ ID NO: 4831 - RNA, 20 nt, Artificial Sequence
  spacer sequence
caaucuccugaccucaggug

SEQ ID NO: 4832 - RNA, 20 nt, Artificial Sequence
  spacer sequence
uggccaggcuggucucaauc

SEQ ID NO: 4833 - RNA, 20 nt, Artificial Sequence
  spacer sequence
cuacugaaaacacaaaaaau

SEQ ID NO: 4834 - RNA, 20 nt, Artificial Sequence
  spacer sequence
acugaaaacacaaaaaauga

SEQ ID NO: 4835 - RNA, 20 nt, Artificial Sequence
  spacer sequence
guagagacaggguuuugcca

SEQ ID NO: 4836 - RNA, 20 nt, Artificial Sequence
  spacer sequence
uuuuuuguguuuucaguaga

SEQ ID NO: 4837 - RNA, 20 nt, Artificial Sequence
  spacer sequence
cagcuacuugggaggcuaag

SEQ ID NO: 4838 - RNA, 20 nt, Artificial Sequence
  spacer sequence
caaguagcugggauuacagg

SEQ ID NO: 4839 - RNA, 20 nt, Artificial Sequence
  spacer sequence
ugccuuagccucccaaguag

SEQ ID NO: 4840 - RNA, 20 nt, Artificial Sequence
  spacer sequence
ccugccuuagccucccaagu

SEQ ID NO: 4841 - RNA, 20 nt, Artificial Sequence
  spacer sequence
agcaauucuccugccuuagc

SEQ ID NO: 4842 - RNA, 20 nt, Artificial Sequence
  spacer sequence
ggagguggagguugcaguga

SEQ ID NO: 4843 - RNA, 20 nt, Artificial Sequence
  spacer sequence
cgaguucaagcaauucuccu

SEQ ID NO: 4844 - RNA, 20 nt, Artificial Sequence
  spacer sequence
accucccgaguucaagcaau

SEQ ID NO: 4845 - RNA, 20 nt, Artificial Sequence
  spacer sequence
cugcaaccuccaccucccga

SEQ ID NO: 4846 - RNA, 20 nt, Artificial Sequence
  spacer sequence
gcucacugcaaccuccaccu

SEQ ID NO: 4847 - RNA, 20 nt, Artificial Sequence
  spacer sequence
cggcucacugcaaccuccac

SEQ ID NO: 4848 - RNA, 20 nt, Artificial Sequence
  spacer sequence
ugccauugcacuccagccug

SEQ ID NO: 4849 - RNA, 20 nt, Artificial Sequence
  spacer sequence
agccuggcugacagagagag

SEQ ID NO: 4850 - RNA, 20 nt, Artificial Sequence
  spacer sequence
gccaggcuggagugcaaugg

SEQ ID NO: 4851 - RNA, 20 nt, Artificial Sequence
  spacer sequence
gucagccaggcuggagugca

SEQ ID NO: 4852 - RNA, 20 nt, Artificial Sequence
  spacer sequence
cugucagccaggcuggagug

SEQ ID NO: 4853 - RNA, 20 nt, Artificial Sequence
  spacer sequence
cucugucagccaggcuggag

SEQ ID NO: 4854 - RNA, 20 nt, Artificial Sequence
  spacer sequence
cucucugucagccaggcugg

SEQ ID NO: 4855 - RNA, 20 nt, Artificial Sequence
  spacer sequence
gucucagaaaaacaaacaaa

SEQ ID NO: 4856 - RNA, 20 nt, Artificial Sequence
  spacer sequence
cagaaaaacaaacaaaccag

SEQ ID NO: 4857 - RNA, 20 nt, Artificial Sequence
  spacer sequence
gaaaaacaaacaaaccagaa

SEQ ID NO: 4858 - RNA, 20 nt, Artificial Sequence
  spacer sequence
gagacagagucucucucugu

SEQ ID NO: 4859 - RNA, 20 nt, Artificial Sequence
  spacer sequence
gguuuguuuguuuuucugag

SEQ ID NO: 4860 - RNA, 20 nt, Artificial Sequence
  spacer sequence
guuugugguaguuguuuuuc

SEQ ID NO: 4861 - RNA, 20 nt, Artificial Sequence
  spacer sequence
guuauauaagccacucaguu

SEQ ID NO: 4862 - RNA, 20 nt, Artificial Sequence
  spacer sequence
cauaguuccagaggcuagga

SEQ ID NO: 4863 - RNA, 20 nt, Artificial Sequence
  spacer sequence
uaguuccagaggcuaggaga

SEQ ID NO: 4864 - RNA, 20 nt, Artificial Sequence
  spacer sequence
agaggcuaggagagaugaag

SEQ ID NO: 4865 - RNA, 20 nt, Artificial Sequence
  spacer sequence
ggaacuaugagacaaugucu

SEQ ID NO: 4866 - RNA, 20 nt, Artificial Sequence
  spacer sequence
uagccucuggaacuaugaga

SEQ ID NO: 4867 - RNA, 20 nt, Artificial Sequence
  spacer sequence
ccuagccucuggaacuauga

SEQ ID NO: 4868 - RNA, 20 nt, Artificial Sequence
  spacer sequence
cuccuagccucuggaacuau

SEQ ID NO: 4869 - RNA, 20 nt, Artificial Sequence
  spacer sequence
ucucuccuagccucuggaac

SEQ ID NO: 4870 - RNA, 20 nt, Artificial Sequence
  spacer sequence
gcaaggcugguuccuucuga

SEQ ID NO: 4871 - RNA, 20 nt, Artificial Sequence
  spacer sequence
uucugaggcugugaagaauc

SEQ ID NO: 4872 - RNA, 20 nt, Artificial Sequence
  spacer sequence
gaggcugugaagaaucugcu

SEQ ID NO: 4873 - RNA, 20 nt, Artificial Sequence
  spacer sequence
gaaggaaccagccuugcuga

SEQ ID NO: 4874 - RNA, 20 nt, Artificial Sequence
  spacer sequence
cagccucagaaggaaccagc

SEQ ID NO: 4875 - RNA, 20 nt, Artificial Sequence
  spacer sequence
ucacagccucagaaggaacc

SEQ ID NO: 4876 - RNA, 20 nt, Artificial Sequence
  spacer sequence
gcuccaugccucuccccuag

SEQ ID NO: 4877 - RNA, 20 nt, Artificial Sequence
  spacer sequence
augccucuccccuagcuuuu

SEQ ID NO: 4878 - RNA, 20 nt, Artificial Sequence
  spacer sequence
ccccuagcuuuuugggguuu

SEQ ID NO: 4879 - RNA, 20 nt, Artificial Sequence
  spacer sequence
ccuagcuuuuugggguuugc

SEQ ID NO: 4880 - RNA, 20 nt, Artificial Sequence
  spacer sequence
gcaaaccccaaaaagcuagg

SEQ ID NO: 4881 - RNA, 20 nt, Artificial Sequence
  spacer sequence
gguguucuuuggcuuguaga

SEQ ID NO: 4882 - RNA, 20 nt, Artificial Sequence
  spacer sequence
uuggcuuguagaagcaccac

SEQ ID NO: 4883 - RNA, 20 nt, Artificial Sequence
  spacer sequence
acaagccaaagaacaccaga

SEQ ID NO: 4884 - RNA, 20 nt, Artificial Sequence
  spacer sequence
cugccuuuauauucacaugg

SEQ ID NO: 4885 - RNA, 20 nt, Artificial Sequence
  spacer sequence
gccuuuauauucacaugggg

SEQ ID NO: 4886 - RNA, 20 nt, Artificial Sequence
  spacer sequence
cauggggguguucucccugu

SEQ ID NO: 4887 - RNA, 20 nt, Artificial Sequence
  spacer sequence
cccugugugcuuauguccaa

SEQ ID NO: 4888 - RNA, 20 nt, Artificial Sequence
  spacer sequence
cugugugcuuauguccaaau

SEQ ID NO: 4889 - RNA, 20 nt, Artificial Sequence
  spacer sequence
aaauuuccucuuuuguaagg

SEQ ID NO: 4890 - RNA, 20 nt, Artificial Sequence
  spacer sequence
ucuuuuguaaggacaccagu

SEQ ID NO: 4891 - RNA, 20 nt, Artificial Sequence
  spacer sequence
uuuguaaggacaccagucau

SEQ ID NO: 4892 - RNA, 20 nt, Artificial Sequence
  spacer sequence
uuacaaaagaggaaauuugg

SEQ ID NO: 4893 - RNA, 20 nt, Artificial Sequence
  spacer sequence
ugcuggacuuagggguucau

SEQ ID NO: 4894 - RNA, 20 nt, Artificial Sequence
  spacer sequence
agcaugacugguguccuuac

SEQ ID NO: 4895 - RNA, 20 nt, Artificial Sequence
  spacer sequence
uccuacuccaguaugaccuu

SEQ ID NO: 4896 - RNA, 20 nt, Artificial Sequence
  spacer sequence
uacuccaguaugaccuuauc

SEQ ID NO: 4897 - RNA, 20 nt, Artificial Sequence
  spacer sequence
aguaugaccuuaucuuaacu

SEQ ID NO: 4898 - RNA, 20 nt, Artificial Sequence
  spacer sequence
uacuggaguaggaugaaccc

SEQ ID NO: 4899 - RNA, 20 nt, Artificial Sequence
  spacer sequence
uaacuaauuacaucugcaaa

SEQ ID NO: 4900 - RNA, 20 nt, Artificial Sequence
  spacer sequence
gcaaaaccccauuuccaaac

SEQ ID NO: 4901 - RNA, 20 nt, Artificial Sequence
  spacer sequence
aaacauggucaccuuccaag

SEQ ID NO: 4902 - RNA, 20 nt, Artificial Sequence
  spacer sequence
ccuuccaaguuauugggggu

SEQ ID NO: 4903 - RNA, 20 nt, Artificial Sequence
  spacer sequence
aaguuauuggggguuaaaac

SEQ ID NO: 4904 - RNA, 20 nt, Artificial Sequence
  spacer sequence
gggcugggcgugguggcuca

SEQ ID NO: 4905 - RNA, 20 nt, Artificial Sequence
  spacer sequence
ugccuguaaucccagcaguu

SEQ ID NO: 4906 - RNA, 20 nt, Artificial Sequence
  spacer sequence
cagcaguuuggaaggccgag

SEQ ID NO: 4907 - RNA, 20 nt, Artificial Sequence
  spacer sequence
aaacugcugggauuacaggc

SEQ ID NO: 4908 - RNA, 20 nt, Artificial Sequence
  spacer sequence
gccuuccaaacugcugggau

SEQ ID NO: 4909 - RNA, 20 nt, Artificial Sequence
  spacer sequence
gccugccucggccuuccaaa

SEQ ID NO: 4910 - RNA, 20 nt, Artificial Sequence
  spacer sequence
caaggucaggagaucgagac

SEQ ID NO: 4911 - RNA, 20 nt, Artificial Sequence
  spacer sequence
ggagaucgagaccauccugg

SEQ ID NO: 4912 - RNA, 20 nt, Artificial Sequence
  spacer sequence
ugaccuugugauccgccugc

SEQ ID NO: 4913 - RNA, 20 nt, Artificial Sequence
  spacer sequence
ccugaccuugugauccgccu

SEQ ID NO: 4914 - RNA, 20 nt, Artificial Sequence
  spacer sequence
agaccauccuggcuaacaug

SEQ ID NO: 4915 - RNA, 20 nt, Artificial Sequence
  spacer sequence
aucuccugaccuugugaucc

SEQ ID NO: 4916 - RNA, 20 nt, Artificial Sequence
  spacer sequence
cgaucuccugaccuugugau

SEQ ID NO: 4917 - RNA, 20 nt, Artificial Sequence
  spacer sequence
uggcuaacauggugaaaccc

SEQ ID NO: 4918 - RNA, 20 nt, Artificial Sequence
  spacer sequence
ccauguuagccaggaugguc

SEQ ID NO: 4919 - RNA, 20 nt, Artificial Sequence
  spacer sequence
cuauuaaaaauacaaaaaau

SEQ ID NO: 4920 - RNA, 20 nt, Artificial Sequence
  spacer sequence
auuaaaaauacaaaaaauua

SEQ ID NO: 4921 - RNA, 20 nt, Artificial Sequence
  spacer sequence
cagcuacuugggaggcugag

SEQ ID NO: 4922 - RNA, 20 nt, Artificial Sequence
  spacer sequence
caaguagcugggaugcccgc

SEQ ID NO: 4923 - RNA, 20 nt, Artificial Sequence
  spacer sequence
gccucccaaguagcugggau

SEQ ID NO: 4924 - RNA, 20 nt, Artificial Sequence
  spacer sequence
ugccucagccucccaaguag

SEQ ID NO: 4925 - RNA, 20 nt, Artificial Sequence
  spacer sequence
ccugccucagccucccaagu

SEQ ID NO: 4926 - RNA, 20 nt, Artificial Sequence
  spacer sequence
ugccauucuccugccucagc

SEQ ID NO: 4927 - RNA, 20 nt, Artificial Sequence
  spacer sequence
cagguucaugccauucuccu

SEQ ID NO: 4928 - RNA, 20 nt, Artificial Sequence
  spacer sequence
gccucccagguucaugccau

SEQ ID NO: 4929 - RNA, 20 nt, Artificial Sequence
  spacer sequence
cugcaagcucugccucccag

SEQ ID NO: 4930 - RNA, 20 nt, Artificial Sequence
  spacer sequence
gcucacugcaagcucugccu

SEQ ID NO: 4931 - RNA, 20 nt, Artificial Sequence
  spacer sequence
cggcucacugcaagcucugc

SEQ ID NO: 4932 - RNA, 20 nt, Artificial Sequence
  spacer sequence
cgccacugcacuccagccug

SEQ ID NO: 4933 - RNA, 20 nt, Artificial Sequence
  spacer sequence
agccugggugacagagcgag

SEQ ID NO: 4934 - RNA, 20 nt, Artificial Sequence
  spacer sequence
cccaggcuggagugcagugg

SEQ ID NO: 4935 - RNA, 20 nt, Artificial Sequence
  spacer sequence
gucacccaggcuggagugca

SEQ ID NO: 4936 - RNA, 20 nt, Artificial Sequence
  spacer sequence
cucugucacccaggcuggag

SEQ ID NO: 4937 - RNA, 20 nt, Artificial Sequence
  spacer sequence
cgcucugucacccaggcugg

SEQ ID NO: 4938 - RNA, 20 nt, Artificial Sequence
  spacer sequence
guccaaaaaaauaaaacuuu

SEQ ID NO: 4939 - RNA, 20 nt, Artificial Sequence
  spacer sequence
aaaaaaauaaaacuuuaaca

SEQ ID NO: 4940 - RNA, 20 nt, Artificial Sequence
  spacer sequence
ccaaauacauauguuaaagu

SEQ ID NO: 4941 - RNA, 20 nt, Artificial Sequence
  spacer sequence
acccauaauacauccaaaug

SEQ ID NO: 4942 - RNA, 20 nt, Artificial Sequence
  spacer sequence
aaaugucccucagcuuauga

SEQ ID NO: 4943 - RNA, 20 nt, Artificial Sequence
  spacer sequence
cucagcuuaugagcggaaaa

SEQ ID NO: 4944 - RNA, 20 nt, Artificial Sequence
  spacer sequence
gcuuaugagcggaaaaacga

SEQ ID NO: 4945 - RNA, 20 nt, Artificial Sequence
  spacer sequence
uaagcugagggacauuugga

SEQ ID NO: 4946 - RNA, 20 nt, Artificial Sequence
  spacer sequence
gcucauaagcugagggacau

SEQ ID NO: 4947 - RNA, 20 nt, Artificial Sequence
  spacer sequence
uuuuuccgcucauaagcuga

SEQ ID NO: 4948 - RNA, 20 nt, Artificial Sequence
  spacer sequence
cagauacagucuauccaugu

SEQ ID NO: 4949 - RNA, 20 nt, Artificial Sequence
  spacer sequence
gauacagucuauccauguaa

SEQ ID NO: 4950 - RNA, 20 nt, Artificial Sequence
  spacer sequence
gagaucguuuuuccgcucau

SEQ ID NO: 4951 - RNA, 20 nt, Artificial Sequence
  spacer sequence
auccauguaacagaauagua

SEQ ID NO: 4952 - RNA, 20 nt, Artificial Sequence
  spacer sequence
auguaacagaauaguauuca

SEQ ID NO: 4953 - RNA, 20 nt, Artificial Sequence
  spacer sequence
guuacauggauagacuguau

SEQ ID NO: 4954 - RNA, 20 nt, Artificial Sequence
  spacer sequence
cauauagaaaggcacaaauu

SEQ ID NO: 4955 - RNA, 20 nt, Artificial Sequence
  spacer sequence
auaugugaauacuauucugu

SEQ ID NO: 4956 - RNA, 20 nt, Artificial Sequence
  spacer sequence
guaauuugugccuuucuaua

SEQ ID NO: 4957 - RNA, 20 nt, Artificial Sequence
  spacer sequence
cguuauagcacuuaucugua

SEQ ID NO: 4958 - RNA, 20 nt, Artificial Sequence
  spacer sequence
guucacguuauagcacuuau

SEQ ID NO: 4959 - RNA, 20 nt, Artificial Sequence
  spacer sequence
aaaacaucaugcuaaguaca

SEQ ID NO: 4960 - RNA, 20 nt, Artificial Sequence
  spacer sequence
ugcuaaguacaauaggccag

SEQ ID NO: 4961 - RNA, 20 nt, Artificial Sequence
  spacer sequence
ggccuauuguacuuagcaug

SEQ ID NO: 4962 - RNA, 20 nt, Artificial Sequence
  spacer sequence
uuugcaucuggccuauugua

SEQ ID NO: 4963 - RNA, 20 nt, Artificial Sequence
  spacer sequence
uacaauacacugucuuuugc

SEQ ID NO: 4964 - RNA, 20 nt, Artificial Sequence
  spacer sequence
uguaaauaguaucauacaau

SEQ ID NO: 4965 - RNA, 20 nt, Artificial Sequence
  spacer sequence
agaaagggcaaauuuauuga

SEQ ID NO: 4966 - RNA, 20 nt, Artificial Sequence
  spacer sequence
ggacauuucauguaaauagu

SEQ ID NO: 4967 - RNA, 20 nt, Artificial Sequence
  spacer sequence
auaaauuugcccuuucugga

SEQ ID NO: 4968 - RNA, 20 nt, Artificial Sequence
  spacer sequence
gucaauaaauuugcccuuuc

SEQ ID NO: 4969 - RNA, 20 nt, Artificial Sequence
  spacer sequence
gugguugccugcagcuuggg

SEQ ID NO: 4970 - RNA, 20 nt, Artificial Sequence
  spacer sequence
caccccaagcugcaggcaac

SEQ ID NO: 4971 - RNA, 20 nt, Artificial Sequence
  spacer sequence
cccaccccaagcugcaggca

SEQ ID NO: 4972 - RNA, 20 nt, Artificial Sequence
  spacer sequence
cuucucccaccccaagcugc

SEQ ID NO: 4973 - RNA, 20 nt, Artificial Sequence
  spacer sequence
ugguaguuuuugcuuaaucc

SEQ ID NO: 4974 - RNA, 20 nt, Artificial Sequence
  spacer sequence
gcccaauuuaccucauggua

SEQ ID NO: 4975 - RNA, 20 nt, Artificial Sequence
  spacer sequence
aucagcccaauuuaccucau

SEQ ID NO: 4976 - RNA, 20 nt, Artificial Sequence
  spacer sequence
acuacauaaauuuacuuuaa

SEQ ID NO: 4977 - RNA, 20 nt, Artificial Sequence
  spacer sequence
uuaaagugcaugcuuacaaa

SEQ ID NO: 4978 - RNA, 20 nt, Artificial Sequence
  spacer sequence
cccuuuguaagcaugcacuu

SEQ ID NO: 4979 - RNA, 20 nt, Artificial Sequence
  spacer sequence
uaauaaaacuguuaaaaaaa

SEQ ID NO: 4980 - RNA, 20 nt, Artificial Sequence
  spacer sequence
cagguuguggagcagcaauu

SEQ ID NO: 4981 - RNA, 20 nt, Artificial Sequence
  spacer sequence
acaaccugggagguuugguu

SEQ ID NO: 4982 - RNA, 20 nt, Artificial Sequence
  spacer sequence
uuuaaaaaaaauugcugcuc

SEQ ID NO: 4983 - RNA, 20 nt, Artificial Sequence
  spacer sequence
uuuuuuuuuuuuuuuuuuuu

SEQ ID NO: 4984 - RNA, 20 nt, Artificial Sequence
  spacer sequence
cacucuguugcccaggcugg

SEQ ID NO: 4985 - RNA, 20 nt, Artificial Sequence
  spacer sequence
cucuguugcccaggcuggag

SEQ ID NO: 4986 - RNA, 20 nt, Artificial Sequence
  spacer sequence
guugcccaggcuggagugca

SEQ ID NO: 4987 - RNA, 20 nt, Artificial Sequence
  spacer sequence
agccugggcaacagagugag

SEQ ID NO: 4988 - RNA, 20 nt, Artificial Sequence
  spacer sequence
gcacuccagccugggcaaca

SEQ ID NO: 4989 - RNA, 20 nt, Artificial Sequence
  spacer sequence
caccucugcacuccagccug

SEQ ID NO: 4990 - RNA, 20 nt, Artificial Sequence
  spacer sequence
cugcucacugcaaccucugc

SEQ ID NO: 4991 - RNA, 20 nt, Artificial Sequence
  spacer sequence
gcucacugcaaccucugcca

SEQ ID NO: 4992 - RNA, 20 nt, Artificial Sequence
  spacer sequence
cugcaaccucugccaccuga

SEQ ID NO: 4993 - RNA, 20 nt, Artificial Sequence
  spacer sequence
gccaccugaguucaagcaau

SEQ ID NO: 4994 - RNA, 20 nt, Artificial Sequence
  spacer sequence
gguggcagagguugcaguga

SEQ ID NO: 4995 - RNA, 20 nt, Artificial Sequence
  spacer sequence
agcaauucugccaccucagu

SEQ ID NO: 4996 - RNA, 20 nt, Artificial Sequence
  spacer sequence
gccaccucagucuccugggu

SEQ ID NO: 4997 - RNA, 20 nt, Artificial Sequence
  spacer sequence
gucuccuggguagcugagac

SEQ ID NO: 4998 - RNA, 20 nt, Artificial Sequence
  spacer sequence
ccuggguagcugagacuaua

SEQ ID NO: 4999 - RNA, 20 nt, Artificial Sequence
  spacer sequence
uggguagcugagacuauagg

SEQ ID NO: 5000 - RNA, 20 nt, Artificial Sequence
  spacer sequence
gcuacccaggagacugaggu

SEQ ID NO: 5001 - RNA, 20 nt, Artificial Sequence
  spacer sequence
cagcuacccaggagacugag

SEQ ID NO: 5002 - RNA, 20 nt, Artificial Sequence
  spacer sequence
acaaaaaauacaaaaacuag

SEQ ID NO: 5003 - RNA, 20 nt, Artificial Sequence
  spacer sequence
ggguuucaccauguugccca

SEQ ID NO: 5004 - RNA, 20 nt, Artificial Sequence
  spacer sequence
ccauguugcccaggcugguc

SEQ ID NO: 5005 - RNA, 20 nt, Artificial Sequence
  spacer sequence
caaacuccugggcugaagug

SEQ ID NO: 5006 - RNA, 20 nt, Artificial Sequence
  spacer sequence
aacuccugggcugaagugau

SEQ ID NO: 5007 - RNA, 20 nt, Artificial Sequence
  spacer sequence
ugggcugaagugaucugccc

SEQ ID NO: 5008 - RNA, 20 nt, Artificial Sequence
  spacer sequence
gcccaggaguuugagaccag

SEQ ID NO: 5009 - RNA, 20 nt, Artificial Sequence
  spacer sequence
cuucagcccaggaguuugag

SEQ ID NO: 5010 - RNA, 20 nt, Artificial Sequence
  spacer sequence
gcccgucuccgccuccaaaa

SEQ ID NO: 5011 - RNA, 20 nt, Artificial Sequence
  spacer sequence
ccgccuccaaaagugcuggg

SEQ ID NO: 5012 - RNA, 20 nt, Artificial Sequence
  spacer sequence
gccuccaaaagugcugggau

SEQ ID NO: 5013 - RNA, 20 nt, Artificial Sequence
  spacer sequence
aaaagugcugggauuauagg

SEQ ID NO: 5014 - RNA, 20 nt, Artificial Sequence
  spacer sequence
cagcacuuuuggaggcggag

SEQ ID NO: 5015 - RNA, 20 nt, Artificial Sequence
  spacer sequence
acccuauaaucccagcacuu

SEQ ID NO: 5016 - RNA, 20 nt, Artificial Sequence
  spacer sequence
uuaaaaacagaaagaaguug

SEQ ID NO: 5017 - RNA, 20 nt, Artificial Sequence
  spacer sequence
guuuuuaaggaaaggggcug

SEQ ID NO: 5018 - RNA, 20 nt, Artificial Sequence
  spacer sequence
uucuguuuuuaaggaaaggg

SEQ ID NO: 5019 - RNA, 20 nt, Artificial Sequence
  spacer sequence
caacuucuuucuguuuuuaa

SEQ ID NO: 5020 - RNA, 20 nt, Artificial Sequence
  spacer sequence
gcuucacaacuucuuucugu

SEQ ID NO: 5021 - RNA, 20 nt, Artificial Sequence
  spacer sequence
uccugucaugauaaagguau

SEQ ID NO: 5022 - RNA, 20 nt, Artificial Sequence
  spacer sequence
ugucaugauaaagguaugac

SEQ ID NO: 5023 - RNA, 20 nt, Artificial Sequence
  spacer sequence
ugauaaagguaugacuaaau

SEQ ID NO: 5024 - RNA, 20 nt, Artificial Sequence
  spacer sequence
ugacaggaugauucugcuuc

SEQ ID NO: 5025 - RNA, 20 nt, Artificial Sequence
  spacer sequence
uaccuuuaucaugacaggau

SEQ ID NO: 5026 - RNA, 20 nt, Artificial Sequence
  spacer sequence
cguauuauuuagucauaccu

SEQ ID NO: 5027 - RNA, 20 nt, Artificial Sequence
  spacer sequence
auuaacucuucacaagugua

SEQ ID NO: 5028 - RNA, 20 nt, Artificial Sequence
  spacer sequence
ucacaaguguaaugaucuca

SEQ ID NO: 5029 - RNA, 20 nt, Artificial Sequence
  spacer sequence
caaguguaaugaucucaaac

SEQ ID NO: 5030 - RNA, 20 nt, Artificial Sequence
  spacer sequence
uuacacuugugaagaguuaa

SEQ ID NO: 5031 - RNA, 20 nt, Artificial Sequence
  spacer sequence
caaacaaaauauacuacccu

SEQ ID NO: 5032 - RNA, 20 nt, Artificial Sequence
  spacer sequence
aacaaaauauacuacccuuc

SEQ ID NO: 5033 - RNA, 20 nt, Artificial Sequence
  spacer sequence
ucucaacuuaaauaccaauc

SEQ ID NO: 5034 - RNA, 20 nt, Artificial Sequence
  spacer sequence
caacuuaaauaccaaucuuc

SEQ ID NO: 5035 - RNA, 20 nt, Artificial Sequence
  spacer sequence
acuuaaauaccaaucuucau

SEQ ID NO: 5036 - RNA, 20 nt, Artificial Sequence
  spacer sequence
ucaugcaauaaguaaaaucu

SEQ ID NO: 5037 - RNA, 20 nt, Artificial Sequence
  spacer sequence
ugcaauaaguaaaaucugca

SEQ ID NO: 5038 - RNA, 20 nt, Artificial Sequence
  spacer sequence
gcacugaugagacuuuuaaa

SEQ ID NO: 5039 - RNA, 20 nt, Artificial Sequence
  spacer sequence
gugcagauuuuacuuauugc

SEQ ID NO: 5040 - RNA, 20 nt, Artificial Sequence
  spacer sequence
ucagugcagauuuuacuuau

SEQ ID NO: 5041 - RNA, 20 nt, Artificial Sequence
  spacer sequence
caucagugcagauuuuacuu

SEQ ID NO: 5042 - RNA, 20 nt, Artificial Sequence
  spacer sequence
uaugugguggggcugcuguu

SEQ ID NO: 5043 - RNA, 20 nt, Artificial Sequence
  spacer sequence
aacccgcagccuauggugcc

SEQ ID NO: 5044 - RNA, 20 nt, Artificial Sequence
  spacer sequence
ugggccacaggcaccauagg

SEQ ID NO: 5045 - RNA, 20 nt, Artificial Sequence
  spacer sequence
uaaacuuucuuaaaauguga

SEQ ID NO: 5046 - RNA, 20 nt, Artificial Sequence
  spacer sequence
uaaaaugugagauugccuuu

SEQ ID NO: 5047 - RNA, 20 nt, Artificial Sequence
  spacer sequence
cauuuuaagaaaguuuauga

SEQ ID NO: 5048 - RNA, 20 nt, Artificial Sequence
  spacer sequence
cacauuuuaagaaaguuuau

SEQ ID NO: 5049 - RNA, 20 nt, Artificial Sequence
  spacer sequence
caaaggcaaucucacauuuu

SEQ ID NO: 5050 - RNA, 20 nt, Artificial Sequence
  spacer sequence
ccagcuaucauuaguguuaa

SEQ ID NO: 5051 - RNA, 20 nt, Artificial Sequence
  spacer sequence
uuaguguuaacguauuuuau

SEQ ID NO: 5052 - RNA, 20 nt, Artificial Sequence
  spacer sequence
ugggccacacauaaaauacg

SEQ ID NO: 5053 - RNA, 20 nt, Artificial Sequence
  spacer sequence
ucaaauauagccaauuugaa

SEQ ID NO: 5054 - RNA, 20 nt, Artificial Sequence
  spacer sequence
aauauagccaauuugaagcc

SEQ ID NO: 5055 - RNA, 20 nt, Artificial Sequence
  spacer sequence
aauuggcuauauuugaagaa

SEQ ID NO: 5056 - RNA, 20 nt, Artificial Sequence
  spacer sequence
ccugggccauauuggcuuca

SEQ ID NO: 5057 - RNA, 20 nt, Artificial Sequence
  spacer sequence
ccaucaccugggccauauug

SEQ ID NO: 5058 - RNA, 20 nt, Artificial Sequence
  spacer sequence
uuucaaguuuaagucucacc

SEQ ID NO: 5059 - RNA, 20 nt, Artificial Sequence
  spacer sequence
aguuuaagucucacccaacu

SEQ ID NO: 5060 - RNA, 20 nt, Artificial Sequence
  spacer sequence
cacccaacuccuacccaccu

SEQ ID NO: 5061 - RNA, 20 nt, Artificial Sequence
  spacer sequence
cccaacuccuacccaccuag

SEQ ID NO: 5062 - RNA, 20 nt, Artificial Sequence
  spacer sequence
uacccaccuaguaggguaga

SEQ ID NO: 5063 - RNA, 20 nt, Artificial Sequence
  spacer sequence
acccuacuagguggguagga

SEQ ID NO: 5064 - RNA, 20 nt, Artificial Sequence
  spacer sequence
uuaagaaaauuaugugccuu

SEQ ID NO: 5065 - RNA, 20 nt, Artificial Sequence
  spacer sequence
uaaugaaccucuacccuacu

SEQ ID NO: 5066 - RNA, 20 nt, Artificial Sequence
  spacer sequence
cuuuaaggcacauaauuuuc

SEQ ID NO: 5067 - RNA, 20 nt, Artificial Sequence
  spacer sequence
auucccuuuaaggcacauaa

SEQ ID NO: 5068 - RNA, 20 nt, Artificial Sequence
  spacer sequence
aaguuguuuuuuaaaaaugu

SEQ ID NO: 5069 - RNA, 20 nt, Artificial Sequence
  spacer sequence
ugccuauaauccuagcacuu

SEQ ID NO: 5070 - RNA, 20 nt, Artificial Sequence
  spacer sequence
uagcacuuggggaggcugag

SEQ ID NO: 5071 - RNA, 20 nt, Artificial Sequence
  spacer sequence
ccaagugcuaggauuauagg

SEQ ID NO: 5072 - RNA, 20 nt, Artificial Sequence
  spacer sequence
gccuccccaagugcuaggau

SEQ ID NO: 5073 - RNA, 20 nt, Artificial Sequence
  spacer sequence
accugccucagccuccccaa

SEQ ID NO: 5074 - RNA, 20 nt, Artificial Sequence
  spacer sequence
agcaauccaccugccucagc

SEQ ID NO: 5075 - RNA, 20 nt, Artificial Sequence
  spacer sequence
ugggcucaagcaauccaccu

SEQ ID NO: 5076 - RNA, 20 nt, Artificial Sequence
  spacer sequence
aaaugagcuugggcaacaua

SEQ ID NO: 5077 - RNA, 20 nt, Artificial Sequence
  spacer sequence
uuuagaacuccugggcucaa

SEQ ID NO: 5078 - RNA, 20 nt, Artificial Sequence
  spacer sequence
cuauguugcccaagcucauu

SEQ ID NO: 5079 - RNA, 20 nt, Artificial Sequence
  spacer sequence
cccuauguugcccaagcuca

SEQ ID NO: 5080 - RNA, 20 nt, Artificial Sequence
  spacer sequence
cuaccaaaaaauaaaaaaaa

SEQ ID NO: 5081 - RNA, 20 nt, Artificial Sequence
  spacer sequence
accaaaaaauaaaaaaaaaa

SEQ ID NO: 5082 - RNA, 20 nt, Artificial Sequence
  spacer sequence
ccuguagucccagugagagg

SEQ ID NO: 5083 - RNA, 20 nt, Artificial Sequence
  spacer sequence
cagugagaggugacagcaug

SEQ ID NO: 5084 - RNA, 20 nt, Artificial Sequence
  spacer sequence
cugggacuacaggugagcac

SEQ ID NO: 5085 - RNA, 20 nt, Artificial Sequence
  spacer sequence
cacugggacuacaggugagc

SEQ ID NO: 5086 - RNA, 20 nt, Artificial Sequence
  spacer sequence
ccucucacugggacuacagg

SEQ ID NO: 5087 - RNA, 20 nt, Artificial Sequence
  spacer sequence
ucagaggccucacucgcucu

SEQ ID NO: 5088 - RNA, 20 nt, Artificial Sequence
  spacer sequence
gaggccucacucgcucucgg

SEQ ID NO: 5089 - RNA, 20 nt, Artificial Sequence
  spacer sequence
gaggacugccagcaugcugu

SEQ ID NO: 5090 - RNA, 20 nt, Artificial Sequence
  spacer sequence
cucgcucucggcaccuccuc

SEQ ID NO: 5091 - RNA, 20 nt, Artificial Sequence
  spacer sequence
cucucggcaccuccucugcc

SEQ ID NO: 5092 - RNA, 20 nt, Artificial Sequence
  spacer sequence
cggcaccuccucugccuggg

SEQ ID NO: 5093 - RNA, 20 nt, Artificial Sequence
  spacer sequence
gcaccuccucugccugggcu

SEQ ID NO: 5094 - RNA, 20 nt, Artificial Sequence
  spacer sequence
ucugccugggcucccacuuu

SEQ ID NO: 5095 - RNA, 20 nt, Artificial Sequence
  spacer sequence
gccugggcucccacuuuggc

SEQ ID NO: 5096 - RNA, 20 nt, Artificial Sequence
  spacer sequence
cacuuuggcagcacuugagg

SEQ ID NO: 5097 - RNA, 20 nt, Artificial Sequence
  spacer sequence
agugcugccaaagugggagc

SEQ ID NO: 5098 - RNA, 20 nt, Artificial Sequence
  spacer sequence
ucaagugcugccaaaguggg

SEQ ID NO: 5099 - RNA, 20 nt, Artificial Sequence
  spacer sequence
gcccaccgcugcacuguggg

SEQ ID NO: 5100 - RNA, 20 nt, Artificial Sequence
  spacer sequence
cacagugcagcggugggcug

SEQ ID NO: 5101 - RNA, 20 nt, Artificial Sequence
  spacer sequence
gggcuggccaaggccggagc

SEQ ID NO: 5102 - RNA, 20 nt, Artificial Sequence
  spacer sequence
ggccuuggccagcccagaaa

SEQ ID NO: 5103 - RNA, 20 nt, Artificial Sequence
  spacer sequence
cucagcuugcaaggaggugu

SEQ ID NO: 5104 - RNA, 20 nt, Artificial Sequence
  spacer sequence
gcuugcaaggagguguggag

SEQ ID NO: 5105 - RNA, 20 nt, Artificial Sequence
  spacer sequence
uugcaagcugagggagccag

SEQ ID NO: 5106 - RNA, 20 nt, Artificial Sequence
  spacer sequence
acaccuccuugcaagcugag

SEQ ID NO: 5107 - RNA, 20 nt, Artificial Sequence
  spacer sequence
cuccacaccuccuugcaagc

SEQ ID NO: 5108 - RNA, 20 nt, Artificial Sequence
  spacer sequence
cccuccacaccuccuugcaa

SEQ ID NO: 5109 - RNA, 20 nt, Artificial Sequence
  spacer sequence
ugccucucccuccacaccuc

SEQ ID NO: 5110 - RNA, 20 nt, Artificial Sequence
  spacer sequence
cgcucaugccucucccucca

SEQ ID NO: 5111 - RNA, 20 nt, Artificial Sequence
  spacer sequence
gggccagcuggagcuccagg

SEQ ID NO: 5112 - RNA, 20 nt, Artificial Sequence
  spacer sequence
agcuggcccggaagugcccg

SEQ ID NO: 5113 - RNA, 20 nt, Artificial Sequence
  spacer sequence
aggugugcgugggcuuggcg

SEQ ID NO: 5114 - RNA, 20 nt, Artificial Sequence
  spacer sequence
gagcagccggcaggcccugc

SEQ ID NO: 5115 - RNA, 20 nt, Artificial Sequence
  spacer sequence
gagugcgggcccgccaagcc

SEQ ID NO: 5116 - RNA, 20 nt, Artificial Sequence
  spacer sequence
uugcauggggccggcagggc

SEQ ID NO: 5117 - RNA, 20 nt, Artificial Sequence
  spacer sequence
acagccgcuggcccuggugc

SEQ ID NO: 5118 - RNA, 20 nt, Artificial Sequence
  spacer sequence
gagcagugccgcccaccggc

SEQ ID NO: 5119 - RNA, 20 nt, Artificial Sequence
  spacer sequence
gaguacagggccuccacagc

SEQ ID NO: 5120 - RNA, 20 nt, Artificial Sequence
  spacer sequence
auuucucaccggccuuagcu

SEQ ID NO: 5121 - RNA, 20 nt, Artificial Sequence
  spacer sequence
agcccagugccggugggcgg

SEQ ID NO: 5122 - RNA, 20 nt, Artificial Sequence
  spacer sequence
caccggccuuagcugccucc

SEQ ID NO: 5123 - RNA, 20 nt, Artificial Sequence
  spacer sequence
ccggccuuagcugccucccu

SEQ ID NO: 5124 - RNA, 20 nt, Artificial Sequence
  spacer sequence
cugcggggcauggcucggga

SEQ ID NO: 5125 - RNA, 20 nt, Artificial Sequence
  spacer sequence
ggaccugcagcccgccaugc

SEQ ID NO: 5126 - RNA, 20 nt, Artificial Sequence
  spacer sequence
cgagccaugccccgcaggga

SEQ ID NO: 5127 - RNA, 20 nt, Artificial Sequence
  spacer sequence
ggcauggcgggcugcagguc

SEQ ID NO: 5128 - RNA, 20 nt, Artificial Sequence
  spacer sequence
cccucucugugggcugcugu

SEQ ID NO: 5129 - RNA, 20 nt, Artificial Sequence
  spacer sequence
cugugggcugcugugcugcc

SEQ ID NO: 5130 - RNA, 20 nt, Artificial Sequence
  spacer sequence
gugggcugcugugcugccgg

SEQ ID NO: 5131 - RNA, 20 nt, Artificial Sequence
  spacer sequence
ggcagcacagcagcccacag

SEQ ID NO: 5132 - RNA, 20 nt, Artificial Sequence
  spacer sequence
ccgacaagcaccgcccccug

SEQ ID NO: 5133 - RNA, 20 nt, Artificial Sequence
  spacer sequence
gggaggcuccggcagcacag

SEQ ID NO: 5134 - RNA, 20 nt, Artificial Sequence
  spacer sequence
acggcgcccagucccaucga

SEQ ID NO: 5135 - RNA, 20 nt, Artificial Sequence
  spacer sequence
caucgacgacccaagggcug

SEQ ID NO: 5136 - RNA, 20 nt, Artificial Sequence
  spacer sequence
acgacccaagggcugaggag

SEQ ID NO: 5137 - RNA, 20 nt, Artificial Sequence
  spacer sequence
augggacugggcgccguaga

SEQ ID NO: 5138 - RNA, 20 nt, Artificial Sequence
  spacer sequence
ucgaugggacugggcgccgu

SEQ ID NO: 5139 - RNA, 20 nt, Artificial Sequence
  spacer sequence
gcccuugggucgucgauggg

SEQ ID NO: 5140 - RNA, 20 nt, Artificial Sequence
  spacer sequence
ucagcccuugggucgucgau

SEQ ID NO: 5141 - RNA, 20 nt, Artificial Sequence
  spacer sequence
caugccgugcacccgcacuc

SEQ ID NO: 5142 - RNA, 20 nt, Artificial Sequence
  spacer sequence
accugcagcccaggugcggg

SEQ ID NO: 5143 - RNA, 20 nt, Artificial Sequence
  spacer sequence
cgcaccugggcugcaggugg

SEQ ID NO: 5144 - RNA, 20 nt, Artificial Sequence
  spacer sequence
acugggugacgccagcuggg

SEQ ID NO: 5145 - RNA, 20 nt, Artificial Sequence
  spacer sequence
cccaguggaucccgcaccug

SEQ ID NO: 5146 - RNA, 20 nt, Artificial Sequence
  spacer sequence
ugaguuuaguggggaccugc

SEQ ID NO: 5147 - RNA, 20 nt, Artificial Sequence
  spacer sequence
ggagcccagcuggcgucacc

SEQ ID NO: 5148 - RNA, 20 nt, Artificial Sequence
  spacer sequence
ccacuaaacucaggagccca

SEQ ID NO: 5149 - RNA, 20 nt, Artificial Sequence
  spacer sequence
gcagguccccacuaaacuca

SEQ ID NO: 5150 - RNA, 20 nt, Artificial Sequence
  spacer sequence
agcuaagggauuguaaaugc

SEQ ID NO: 5151 - RNA, 20 nt, Artificial Sequence
  spacer sequence
cuuagcuagacauaaagguu

SEQ ID NO: 5152 - RNA, 20 nt, Artificial Sequence
  spacer sequence
gcacccugugucuagcucag

SEQ ID NO: 5153 - RNA, 20 nt, Artificial Sequence
  spacer sequence
agcucaggguuugugaaugc

SEQ ID NO: 5154 - RNA, 20 nt, Artificial Sequence
  spacer sequence
ggguuugugaaugcacgaau

SEQ ID NO: 5155 - RNA, 20 nt, Artificial Sequence
  spacer sequence
caaacccugagcuagacaca

SEQ ID NO: 5156 - RNA, 20 nt, Artificial Sequence
  spacer sequence
ugcauucacaaacccugagc

SEQ ID NO: 5157 - RNA, 20 nt, Artificial Sequence
  spacer sequence
acacucuguaucuagcuacu

SEQ ID NO: 5158 - RNA, 20 nt, Artificial Sequence
  spacer sequence
auucgugcauucacaaaccc

SEQ ID NO: 5159 - RNA, 20 nt, Artificial Sequence
  spacer sequence
guaucuagcuacucuggugg

SEQ ID NO: 5160 - RNA, 20 nt, Artificial Sequence
  spacer sequence
agcuacucugguggggaggu

SEQ ID NO: 5161 - RNA, 20 nt, Artificial Sequence
  spacer sequence
gguggggagguggagaaccu

SEQ ID NO: 5162 - RNA, 20 nt, Artificial Sequence
  spacer sequence
ccaccagaguagcuagauac

SEQ ID NO: 5163 - RNA, 20 nt, Artificial Sequence
  spacer sequence
accuccccaccagaguagcu

SEQ ID NO: 5164 - RNA, 20 nt, Artificial Sequence
  spacer sequence
ccaccuccccaccagaguag

SEQ ID NO: 5165 - RNA, 20 nt, Artificial Sequence
  spacer sequence
agcucagggauuguaaacac

SEQ ID NO: 5166 - RNA, 20 nt, Artificial Sequence
  spacer sequence
gggauuguaaacacaccaau

SEQ ID NO: 5167 - RNA, 20 nt, Artificial Sequence
  spacer sequence
cugagcuagacacaaagguu

SEQ ID NO: 5168 - RNA, 20 nt, Artificial Sequence
  spacer sequence
gcgcccugucaaaacagacc

SEQ ID NO: 5169 - RNA, 20 nt, Artificial Sequence
  spacer sequence
aaacagaccacucggcucua

SEQ ID NO: 5170 - RNA, 20 nt, Artificial Sequence
  spacer sequence
guuuugacagggcgcugauu

SEQ ID NO: 5171 - RNA, 20 nt, Artificial Sequence
  spacer sequence
gcucuaccaaucagcaggau

SEQ ID NO: 5172 - RNA, 20 nt, Artificial Sequence
  spacer sequence
accaaucagcaggauguggg

SEQ ID NO: 5173 - RNA, 20 nt, Artificial Sequence
  spacer sequence
gcaggauguggguggggcca

SEQ ID NO: 5174 - RNA, 20 nt, Artificial Sequence
  spacer sequence
ugcugauugguagagccgag

SEQ ID NO: 5175 - RNA, 20 nt, Artificial Sequence
  spacer sequence
ggccccacccacauccugcu

SEQ ID NO: 5176 - RNA, 20 nt, Artificial Sequence
  spacer sequence
uuuaucuggccccacccaca

SEQ ID NO: 5177 - RNA, 20 nt, Artificial Sequence
  spacer sequence
ggcagccugcuuuuauucuu

SEQ ID NO: 5178 - RNA, 20 nt, Artificial Sequence
  spacer sequence
ccuuccauacuguggaagcu

SEQ ID NO: 5179 - RNA, 20 nt, Artificial Sequence
  spacer sequence
auacuguggaagcuuugucu

SEQ ID NO: 5180 - RNA, 20 nt, Artificial Sequence
  spacer sequence
acaguauggaaggggaccca

SEQ ID NO: 5181 - RNA, 20 nt, Artificial Sequence
  spacer sequence
uucuuugcaauaaaucuugc

SEQ ID NO: 5182 - RNA, 20 nt, Artificial Sequence
  spacer sequence
uugcaauaaaucuugcugcu

SEQ ID NO: 5183 - RNA, 20 nt, Artificial Sequence
  spacer sequence
ugcugcugcucacucuuugg

SEQ ID NO: 5184 - RNA, 20 nt, Artificial Sequence
  spacer sequence
cucuuuggguccacacugcc

SEQ ID NO: 5185 - RNA, 20 nt, Artificial Sequence
  spacer sequence
uuggguccacacugccuuua

SEQ ID NO: 5186 - RNA, 20 nt, Artificial Sequence
  spacer sequence
acacugccuuuaugagcugu

SEQ ID NO: 5187 - RNA, 20 nt, Artificial Sequence
  spacer sequence
uaaaggcaguguggacccaa

SEQ ID NO: 5188 - RNA, 20 nt, Artificial Sequence
  spacer sequence
ccacgaaggucugcagcuuc

SEQ ID NO: 5189 - RNA, 20 nt, Artificial Sequence
  spacer sequence
uggugaguguuacagcucau

SEQ ID NO: 5190 - RNA, 20 nt, Artificial Sequence
  spacer sequence
gcagcuucacugcugaagcc

SEQ ID NO: 5191 - RNA, 20 nt, Artificial Sequence
  spacer sequence
cugcugaagccaaugagacc

SEQ ID NO: 5192 - RNA, 20 nt, Artificial Sequence
  spacer sequence
gcagugaagcugcagaccuu

SEQ ID NO: 5193 - RNA, 20 nt, Artificial Sequence
  spacer sequence
uuggcuucagcagugaagcu

SEQ ID NO: 5194 - RNA, 20 nt, Artificial Sequence
  spacer sequence
cauuggcuucagcagugaag

SEQ ID NO: 5195 - RNA, 20 nt, Artificial Sequence
  spacer sequence
uggucucauuggcuucagca

SEQ ID NO: 5196 - RNA, 20 nt, Artificial Sequence
  spacer sequence
cgggggguucguggucucau

SEQ ID NO: 5197 - RNA, 20 nt, Artificial Sequence
  spacer sequence
ucccgggggguucguggucu

SEQ ID NO: 5198 - RNA, 20 nt, Artificial Sequence
  spacer sequence
uuccucccgggggguucgug

SEQ ID NO: 5199 - RNA, 20 nt, Artificial Sequence
  spacer sequence
aguuguucauuccucccggg

SEQ ID NO: 5200 - RNA, 20 nt, Artificial Sequence
  spacer sequence
caaguuguucauuccucccg

SEQ ID NO: 5201 - RNA, 20 nt, Artificial Sequence
  spacer sequence
uaaggcagcgcgucucaagu

SEQ ID NO: 5202 - RNA, 20 nt, Artificial Sequence
  spacer sequence
ccgcgaaggucugcagcuuc

SEQ ID NO: 5203 - RNA, 20 nt, Artificial Sequence
  spacer sequence
cggugaguguuacagcucuu

SEQ ID NO: 5204 - RNA, 20 nt, Artificial Sequence
  spacer sequence
gcagcuucacuccugagcca

SEQ ID NO: 5205 - RNA, 20 nt, Artificial Sequence
  spacer sequence
cuccugagccagcgagacca

SEQ ID NO: 5206 - RNA, 20 nt, Artificial Sequence
  spacer sequence
ugagccagcgagaccacaaa

SEQ ID NO: 5207 - RNA, 20 nt, Artificial Sequence
  spacer sequence
ggagugaagcugcagaccuu

SEQ ID NO: 5208 - RNA, 20 nt, Artificial Sequence
  spacer sequence
cuggcucaggagugaagcug

SEQ ID NO: 5209 - RNA, 20 nt, Artificial Sequence
  spacer sequence
cgcuggcucaggagugaagc

SEQ ID NO: 5210 - RNA, 20 nt, Artificial Sequence
  spacer sequence
gguggguuuguggucucgcu

SEQ ID NO: 5211 - RNA, 20 nt, Artificial Sequence
  spacer sequence
uucugguggguuuguggucu

SEQ ID NO: 5212 - RNA, 20 nt, Artificial Sequence
  spacer sequence
uccuucugguggguuugugg

SEQ ID NO: 5213 - RNA, 20 nt, Artificial Sequence
  spacer sequence
gaacacaucugaacaucaga

SEQ ID NO: 5214 - RNA, 20 nt, Artificial Sequence
  spacer sequence
gaguuucuuccuucuggugg

SEQ ID NO: 5215 - RNA, 20 nt, Artificial Sequence
  spacer sequence
gaacaucagaaggaacaaac

SEQ ID NO: 5216 - RNA, 20 nt, Artificial Sequence
  spacer sequence
gauguguucggaguuucuuc

SEQ ID NO: 5217 - RNA, 20 nt, Artificial Sequence
  spacer sequence
gaaggaacaaacuccggaca

SEQ ID NO: 5218 - RNA, 20 nt, Artificial Sequence
  spacer sequence
gauguucagauguguucgga

SEQ ID NO: 5219 - RNA, 20 nt, Artificial Sequence
  spacer sequence
uucugauguucagauguguu

SEQ ID NO: 5220 - RNA, 20 nt, Artificial Sequence
  spacer sequence
ggacacgccaccuuuaagaa

SEQ ID NO: 5221 - RNA, 20 nt, Artificial Sequence
  spacer sequence
ggaguuuguuccuucugaug

SEQ ID NO: 5222 - RNA, 20 nt, Artificial Sequence
  spacer sequence
uaaagguggcguguccggag

SEQ ID NO: 5223 - RNA, 20 nt, Artificial Sequence
  spacer sequence
ccgcgaggguccacggcuuc

SEQ ID NO: 5224 - RNA, 20 nt, Artificial Sequence
  spacer sequence
cggugaguguuacaguucuu

SEQ ID NO: 5225 - RNA, 20 nt, Artificial Sequence
  spacer sequence
acggcuucauucuugaaguc

SEQ ID NO: 5226 - RNA, 20 nt, Artificial Sequence
  spacer sequence
uucuugaagucagugagacc

SEQ ID NO: 5227 - RNA, 20 nt, Artificial Sequence
  spacer sequence
ugaagucagugagaccaaga

SEQ ID NO: 5228 - RNA, 20 nt, Artificial Sequence
  spacer sequence
agaaugaagccguggacccu

SEQ ID NO: 5229 - RNA, 20 nt, Artificial Sequence
  spacer sequence
gugagaccaagaacccacca

SEQ ID NO: 5230 - RNA, 20 nt, Artificial Sequence
  spacer sequence
cugacuucaagaaugaagcc

SEQ ID NO: 5231 - RNA, 20 nt, Artificial Sequence
  spacer sequence
cacugacuucaagaaugaag

SEQ ID NO: 5232 - RNA, 20 nt, Artificial Sequence
  spacer sequence
uggucucacugacuucaaga

SEQ ID NO: 5233 - RNA, 20 nt, Artificial Sequence
  spacer sequence
ggacacaccagcuacuaggg

SEQ ID NO: 5234 - RNA, 20 nt, Artificial Sequence
  spacer sequence
ggaauugguggguucuuggu

SEQ ID NO: 5235 - RNA, 20 nt, Artificial Sequence
  spacer sequence
cuaguagcugguguguccgg

SEQ ID NO: 5236 - RNA, 20 nt, Artificial Sequence
  spacer sequence
gccucccuaguagcuggugu

SEQ ID NO: 5237 - RNA, 20 nt, Artificial Sequence
  spacer sequence
ccucagccucccuaguagcu

SEQ ID NO: 5238 - RNA, 20 nt, Artificial Sequence
  spacer sequence
ccucaccucagccucccuag

SEQ ID NO: 5239 - RNA, 20 nt, Artificial Sequence
  spacer sequence
ccugaauccaggaagucgag

SEQ ID NO: 5240 - RNA, 20 nt, Artificial Sequence
  spacer sequence
ggugauccccucaccucagc

SEQ ID NO: 5241 - RNA, 20 nt, Artificial Sequence
  spacer sequence
aggaagucgagggugcagug

SEQ ID NO: 5242 - RNA, 20 nt, Artificial Sequence
  spacer sequence
uggauucaggugauccccuc

SEQ ID NO: 5243 - RNA, 20 nt, Artificial Sequence
  spacer sequence
agggugcagugagccgagau

SEQ ID NO: 5244 - RNA, 20 nt, Artificial Sequence
  spacer sequence
acuuccuggauucaggugau

SEQ ID NO: 5245 - RNA, 20 nt, Artificial Sequence
  spacer sequence
cugcacccucgacuuccugg

SEQ ID NO: 5246 - RNA, 20 nt, Artificial Sequence
  spacer sequence
gcucacugcacccucgacuu

SEQ ID NO: 5247 - RNA, 20 nt, Artificial Sequence
  spacer sequence
cggcucacugcacccucgac

SEQ ID NO: 5248 - RNA, 20 nt, Artificial Sequence
  spacer sequence
ugccguuacacuccagccug

SEQ ID NO: 5249 - RNA, 20 nt, Artificial Sequence
  spacer sequence
agccugagugacagagugag

SEQ ID NO: 5250 - RNA, 20 nt, Artificial Sequence
  spacer sequence
ggcuggaguguaacggcaug

SEQ ID NO: 5251 - RNA, 20 nt, Artificial Sequence
  spacer sequence
cucaggcuggaguguaacgg

SEQ ID NO: 5252 - RNA, 20 nt, Artificial Sequence
  spacer sequence
gucacucaggcuggagugua

SEQ ID NO: 5253 - RNA, 20 nt, Artificial Sequence
  spacer sequence
cucugucacucaggcuggag

SEQ ID NO: 5254 - RNA, 20 nt, Artificial Sequence
  spacer sequence
cacucugucacucaggcugg

SEQ ID NO: 5255 - RNA, 20 nt, Artificial Sequence
  spacer sequence
ugugucaaaaaaacagaaca

SEQ ID NO: 5256 - RNA, 20 nt, Artificial Sequence
  spacer sequence
aaaaaacagaacaaaauaaa

SEQ ID NO: 5257 - RNA, 20 nt, Artificial Sequence
  spacer sequence
guuuuuuugacacaagaucu

SEQ ID NO: 5258 - RNA, 20 nt, Artificial Sequence
  spacer sequence
uguuuuauuuuguucuguuu

SEQ ID NO: 5259 - RNA, 20 nt, Artificial Sequence
  spacer sequence
acguucuuguuuuauuuugu

SEQ ID NO: 5260 - RNA, 20 nt, Artificial Sequence
  spacer sequence
gagauggaguccagacuuaa

SEQ ID NO: 5261 - RNA, 20 nt, Artificial Sequence
  spacer sequence
gaauuaacacacagccuauu

SEQ ID NO: 5262 - RNA, 20 nt, Artificial Sequence
  spacer sequence
cagaauuaacacacagccua

SEQ ID NO: 5263 - RNA, 20 nt, Artificial Sequence
  spacer sequence
aucucagaauuaacacacag

SEQ ID NO: 5264 - RNA, 20 nt, Artificial Sequence
  spacer sequence
agacuuaagaaugauccuga

SEQ ID NO: 5265 - RNA, 20 nt, Artificial Sequence
  spacer sequence
ggacuccaucucagaauuaa

SEQ ID NO: 5266 - RNA, 20 nt, Artificial Sequence
  spacer sequence
uaagucuggacuccaucuca

SEQ ID NO: 5267 - RNA, 20 nt, Artificial Sequence
  spacer sequence
uucuuaagucuggacuccau

SEQ ID NO: 5268 - RNA, 20 nt, Artificial Sequence
  spacer sequence
ugaggcuuagacccauaucc

SEQ ID NO: 5269 - RNA, 20 nt, Artificial Sequence
  spacer sequence
ggaucauucuuaagucugga

SEQ ID NO: 5270 - RNA, 20 nt, Artificial Sequence
  spacer sequence
aagccucaggaucauucuua

SEQ ID NO: 5271 - RNA, 20 nt, Artificial Sequence
  spacer sequence
aagaggaugauuccagccug

SEQ ID NO: 5272 - RNA, 20 nt, Artificial Sequence
  spacer sequence
uggauaugggucuaagccuc

SEQ ID NO: 5273 - RNA, 20 nt, Artificial Sequence
  spacer sequence
ucuuggauaugggucuaagc

SEQ ID NO: 5274 - RNA, 20 nt, Artificial Sequence
  spacer sequence
uccucuuggauaugggucua

SEQ ID NO: 5275 - RNA, 20 nt, Artificial Sequence
  spacer sequence
agccuggcacuuauagguuc

SEQ ID NO: 5276 - RNA, 20 nt, Artificial Sequence
  spacer sequence
ucaggcacuucagaugcacc

SEQ ID NO: 5277 - RNA, 20 nt, Artificial Sequence
  spacer sequence
ggcacuucagaugcacccug

SEQ ID NO: 5278 - RNA, 20 nt, Artificial Sequence
  spacer sequence
gaugcacccuguccugaauu

SEQ ID NO: 5279 - RNA, 20 nt, Artificial Sequence
  spacer sequence
gaagugccugaagaaccuau

SEQ ID NO: 5280 - RNA, 20 nt, Artificial Sequence
  spacer sequence
ugaauuaagcccuuuguccu

SEQ ID NO: 5281 - RNA, 20 nt, Artificial Sequence
  spacer sequence
ggacagggugcaucugaagu

SEQ ID NO: 5282 - RNA, 20 nt, Artificial Sequence
  spacer sequence
uugaaccugcuuuccuuggu

SEQ ID NO: 5283 - RNA, 20 nt, Artificial Sequence
  spacer sequence
aggacaaagggcuuaauuca

SEQ ID NO: 5284 - RNA, 20 nt, Artificial Sequence
  spacer sequence
uugguaaacagcaccaaggg

SEQ ID NO: 5285 - RNA, 20 nt, Artificial Sequence
  spacer sequence
agcccccuuggugcuguuua

SEQ ID NO: 5286 - RNA, 20 nt, Artificial Sequence
  spacer sequence
cucucucaccaugcaccucu

SEQ ID NO: 5287 - RNA, 20 nt, Artificial Sequence
  spacer sequence
cucaccaugcaccucuaaug

SEQ ID NO: 5288 - RNA, 20 nt, Artificial Sequence
  spacer sequence
caccaugcaccucuaauggg

SEQ ID NO: 5289 - RNA, 20 nt, Artificial Sequence
  spacer sequence
ccaugcaccucuaaugggug

SEQ ID NO: 5290 - RNA, 20 nt, Artificial Sequence
  spacer sequence
aauggguggcuggacuugug

SEQ ID NO: 5291 - RNA, 20 nt, Artificial Sequence
  spacer sequence
agccacccauuagaggugca

SEQ ID NO: 5292 - RNA, 20 nt, Artificial Sequence
  spacer sequence
gugaucucccagcuuucuuc

SEQ ID NO: 5293 - RNA, 20 nt, Artificial Sequence
  spacer sequence
cggaaaugcaaccacaaguc

SEQ ID NO: 5294 - RNA, 20 nt, Artificial Sequence
  spacer sequence
cccagcuuucuuccagugau

SEQ ID NO: 5295 - RNA, 20 nt, Artificial Sequence
  spacer sequence
cagcuuucuuccagugaugg

SEQ ID NO: 5296 - RNA, 20 nt, Artificial Sequence
  spacer sequence
uccagugauggccuuaggug

SEQ ID NO: 5297 - RNA, 20 nt, Artificial Sequence
  spacer sequence
agugauggccuuaggugggc

SEQ ID NO: 5298 - RNA, 20 nt, Artificial Sequence
  spacer sequence
cuggaagaaagcugggagau

SEQ ID NO: 5299 - RNA, 20 nt, Artificial Sequence
  spacer sequence
uauccugucucccaaauggc

SEQ ID NO: 5300 - RNA, 20 nt, Artificial Sequence
  spacer sequence
ugucucccaaauggccucuc

SEQ ID NO: 5301 - RNA, 20 nt, Artificial Sequence
  spacer sequence
cccaaauggccucucugccu

SEQ ID NO: 5302 - RNA, 20 nt, Artificial Sequence
  spacer sequence
caaauggccucucugccuug

SEQ ID NO: 5303 - RNA, 20 nt, Artificial Sequence
  spacer sequence
cugccuugagucucacccca

SEQ ID NO: 5304 - RNA, 20 nt, Artificial Sequence
  spacer sequence
gccuugagucucaccccauc

SEQ ID NO: 5305 - RNA, 20 nt, Artificial Sequence
  spacer sequence
aggcagagaggccauuuggg

SEQ ID NO: 5306 - RNA, 20 nt, Artificial Sequence
  spacer sequence
caccccaucugcucucaguc

SEQ ID NO: 5307 - RNA, 20 nt, Artificial Sequence
  spacer sequence
ccccaucugcucucagucca

SEQ ID NO: 5308 - RNA, 20 nt, Artificial Sequence
  spacer sequence
gcucucaguccacccacuga

SEQ ID NO: 5309 - RNA, 20 nt, Artificial Sequence
  spacer sequence
caguccacccacugagcuau

SEQ ID NO: 5310 - RNA, 20 nt, Artificial Sequence
  spacer sequence
guccacccacugagcuauuc

SEQ ID NO: 5311 - RNA, 20 nt, Artificial Sequence
  spacer sequence
acccacugagcuauuccaga

SEQ ID NO: 5312 - RNA, 20 nt, Artificial Sequence
  spacer sequence
guggguggacugagagcaga

SEQ ID NO: 5313 - RNA, 20 nt, Artificial Sequence
  spacer sequence
agagaccauucugacucccu

SEQ ID NO: 5314 - RNA, 20 nt, Artificial Sequence
  spacer sequence
ggaauagcucagugggugga

SEQ ID NO: 5315 - RNA, 20 nt, Artificial Sequence
  spacer sequence
cuggaauagcucagugggug

SEQ ID NO: 5316 - RNA, 20 nt, Artificial Sequence
  spacer sequence
gacucccuguggacaccccu

SEQ ID NO: 5317 - RNA, 20 nt, Artificial Sequence
  spacer sequence
gaauggucucuggaauagcu

SEQ ID NO: 5318 - RNA, 20 nt, Artificial Sequence
  spacer sequence
cuguggacaccccucuggug

SEQ ID NO: 5319 - RNA, 20 nt, Artificial Sequence
  spacer sequence
acagggagucagaauggucu

SEQ ID NO: 5320 - RNA, 20 nt, Artificial Sequence
  spacer sequence
gguggcuucuccucucuguc

SEQ ID NO: 5321 - RNA, 20 nt, Artificial Sequence
  spacer sequence
ccucucugucaguuagaaau

SEQ ID NO: 5322 - RNA, 20 nt, Artificial Sequence
  spacer sequence
ucucugucaguuagaaauug

SEQ ID NO: 5323 - RNA, 20 nt, Artificial Sequence
  spacer sequence
cugucaguuagaaauugcuu

SEQ ID NO: 5324 - RNA, 20 nt, Artificial Sequence
  spacer sequence
gucaguuagaaauugcuuuu

SEQ ID NO: 5325 - RNA, 20 nt, Artificial Sequence
  spacer sequence
guuagaaauugcuuuugacu

SEQ ID NO: 5326 - RNA, 20 nt, Artificial Sequence
  spacer sequence
aacugacagagaggagaagc

SEQ ID NO: 5327 - RNA, 20 nt, Artificial Sequence
  spacer sequence
aaagcaauuucuaacugaca

SEQ ID NO: 5328 - RNA, 20 nt, Artificial Sequence
  spacer sequence
cgugaugaaaaguacacaga

SEQ ID NO: 5329 - RNA, 20 nt, Artificial Sequence
  spacer sequence
ugaugaaaaguacacagaua

SEQ ID NO: 5330 - RNA, 20 nt, Artificial Sequence
  spacer sequence
cgagaaaaauaaaccuuuau

SEQ ID NO: 5331 - RNA, 20 nt, Artificial Sequence
  spacer sequence
ucacgagaaaaauaaaccuu

SEQ ID NO: 5332 - RNA, 20 nt, Artificial Sequence
  spacer sequence
guguacuuuucaucacgaga

SEQ ID NO: 5333 - RNA, 20 nt, Artificial Sequence
  spacer sequence
aucgauaaccauugaggguu

SEQ ID NO: 5334 - RNA, 20 nt, Artificial Sequence
  spacer sequence
auaaccauugaggguuucuu

SEQ ID NO: 5335 - RNA, 20 nt, Artificial Sequence
  spacer sequence
auggaaguaggcugcuuauc

SEQ ID NO: 5336 - RNA, 20 nt, Artificial Sequence
  spacer sequence
augguuaucgauggaaguag

SEQ ID NO: 5337 - RNA, 20 nt, Artificial Sequence
  spacer sequence
uaugacucuuacagcaauga

SEQ ID NO: 5338 - RNA, 20 nt, Artificial Sequence
  spacer sequence
uaagaaacccucaaugguua

SEQ ID NO: 5339 - RNA, 20 nt, Artificial Sequence
  spacer sequence
uacagcaaugaaauguguau

SEQ ID NO: 5340 - RNA, 20 nt, Artificial Sequence
  spacer sequence
uugcuguaagagucauaaga

SEQ ID NO: 5341 - RNA, 20 nt, Artificial Sequence
  spacer sequence
uuauacuguaaauacacauu

SEQ ID NO: 5342 - RNA, 20 nt, Artificial Sequence
  spacer sequence
acugcccaggugauucuauu

SEQ ID NO: 5343 - RNA, 20 nt, Artificial Sequence
  spacer sequence
ccugggcaguugaaaacuaa

SEQ ID NO: 5344 - RNA, 20 nt, Artificial Sequence
  spacer sequence
auugugcagccaggguugau

SEQ ID NO: 5345 - RNA, 20 nt, Artificial Sequence
  spacer sequence
acccuggcugcacaauagaa

SEQ ID NO: 5346 - RNA, 20 nt, Artificial Sequence
  spacer sequence
aggcccagugccuuugauuu

SEQ ID NO: 5347 - RNA, 20 nt, Artificial Sequence
  spacer sequence
aaggcacugggccuagaugc

SEQ ID NO: 5348 - RNA, 20 nt, Artificial Sequence
  spacer sequence
gcugcaaaucaaaggcacug

SEQ ID NO: 5349 - RNA, 20 nt, Artificial Sequence
  spacer sequence
agagagaauuauugaaacug

SEQ ID NO: 5350 - RNA, 20 nt, Artificial Sequence
  spacer sequence
agaccucagcugcaaaucaa

SEQ ID NO: 5351 - RNA, 20 nt, Artificial Sequence
  spacer sequence
cuagaccucagcugcaaauc

SEQ ID NO: 5352 - RNA, 20 nt, Artificial Sequence
  spacer sequence
cucuagaccucagcugcaaa

SEQ ID NO: 5353 - RNA, 20 nt, Artificial Sequence
  spacer sequence
auaauucucucuagaccuca

SEQ ID NO: 5354 - RNA, 20 nt, Artificial Sequence
  spacer sequence
cagcuacuugggaggcugag

SEQ ID NO: 5355 - RNA, 20 nt, Artificial Sequence
  spacer sequence
caaguagcugggacugcagu

SEQ ID NO: 5356 - RNA, 20 nt, Artificial Sequence
  spacer sequence
gccucccaaguagcugggac

SEQ ID NO: 5357 - RNA, 20 nt, Artificial Sequence
  spacer sequence
aaccucagccucccaaguag

SEQ ID NO: 5358 - RNA, 20 nt, Artificial Sequence
  spacer sequence
ccaaccucagccucccaagu

SEQ ID NO: 5359 - RNA, 20 nt, Artificial Sequence
  spacer sequence
ccccgcugggcuuaggcaau

SEQ ID NO: 5360 - RNA, 20 nt, Artificial Sequence
  spacer sequence
cuacagccucaccccgcugg

SEQ ID NO: 5361 - RNA, 20 nt, Artificial Sequence
  spacer sequence
agacugcaccaccgcacucc

SEQ ID NO: 5362 - RNA, 20 nt, Artificial Sequence
  spacer sequence
ugacucacuacagccucacc

SEQ ID NO: 5363 - RNA, 20 nt, Artificial Sequence
  spacer sequence
agcccgggcgacagagcaac

SEQ ID NO: 5364 - RNA, 20 nt, Artificial Sequence
  spacer sequence
cccgggcuggagugcggugg

SEQ ID NO: 5365 - RNA, 20 nt, Artificial Sequence
  spacer sequence
gucgcccgggcuggagugcg

SEQ ID NO: 5366 - RNA, 20 nt, Artificial Sequence
  spacer sequence
aucuaaaaaaaaaaaaauuu

SEQ ID NO: 5367 - RNA, 20 nt, Artificial Sequence
  spacer sequence
aaaaaaaaaaaaauuucugg

SEQ ID NO: 5368 - RNA, 20 nt, Artificial Sequence
  spacer sequence
ggucuaccuuuuugcccacc

SEQ ID NO: 5369 - RNA, 20 nt, Artificial Sequence
  spacer sequence
accuuuuugcccaccuuuua

SEQ ID NO: 5370 - RNA, 20 nt, Artificial Sequence
  spacer sequence
gugguuaaaaggugggcaaa

SEQ ID NO: 5371 - RNA, 20 nt, Artificial Sequence
  spacer sequence
ccaaacaugaauuuucacuc

SEQ ID NO: 5372 - RNA, 20 nt, Artificial Sequence
  spacer sequence
uguuuggggaccucuguggu

SEQ ID NO: 5373 - RNA, 20 nt, Artificial Sequence
  spacer sequence
cucucaggaaggcugaaaug

SEQ ID NO: 5374 - RNA, 20 nt, Artificial Sequence
  spacer sequence
caggaaggcugaaaugacac

SEQ ID NO: 5375 - RNA, 20 nt, Artificial Sequence
  spacer sequence
ggaaggcugaaaugacacau

SEQ ID NO: 5376 - RNA, 20 nt, Artificial Sequence
  spacer sequence
ugagagugaaaauucauguu

SEQ ID NO: 5377 - RNA, 20 nt, Artificial Sequence
  spacer sequence
gccuuccugagagugaaaau

SEQ ID NO: 5378 - RNA, 20 nt, Artificial Sequence
  spacer sequence
uuucagccuuccugagagug

SEQ ID NO: 5379 - RNA, 20 nt, Artificial Sequence
  spacer sequence
ucugcacgugccgccaucug

SEQ ID NO: 5380 - RNA, 20 nt, Artificial Sequence
  spacer sequence
gcacgugccgccaucugauu

SEQ ID NO: 5381 - RNA, 20 nt, Artificial Sequence
  spacer sequence
gauuuaaggcaucuauuccu

SEQ ID NO: 5382 - RNA, 20 nt, Artificial Sequence
  spacer sequence
gauggcggcacgugcagaug

SEQ ID NO: 5383 - RNA, 20 nt, Artificial Sequence
  spacer sequence
auuccuccucaccauuccug

SEQ ID NO: 5384 - RNA, 20 nt, Artificial Sequence
  spacer sequence
uccucaccauuccugacaaa

SEQ ID NO: 5385 - RNA, 20 nt, Artificial Sequence
  spacer sequence
ucaccauuccugacaaaguu

SEQ ID NO: 5386 - RNA, 20 nt, Artificial Sequence
  spacer sequence
ccauuccugacaaaguugaa

SEQ ID NO: 5387 - RNA, 20 nt, Artificial Sequence
  spacer sequence
ugacaaaguugaacugucua

SEQ ID NO: 5388 - RNA, 20 nt, Artificial Sequence
  spacer sequence
ggaauggugaggaggaauag

SEQ ID NO: 5389 - RNA, 20 nt, Artificial Sequence
  spacer sequence
acuuugucaggaauggugag

SEQ ID NO: 5390 - RNA, 20 nt, Artificial Sequence
  spacer sequence
acaugugccacauucuccuc

SEQ ID NO: 5391 - RNA, 20 nt, Artificial Sequence
  spacer sequence
ccucuuucucuaauuccuuc

SEQ ID NO: 5392 - RNA, 20 nt, Artificial Sequence
  spacer sequence
ucuuucucuaauuccuuccc

SEQ ID NO: 5393 - RNA, 20 nt, Artificial Sequence
  spacer sequence
uucucuaauuccuucccucc

SEQ ID NO: 5394 - RNA, 20 nt, Artificial Sequence
  spacer sequence
cuaauuccuucccuccuucc

SEQ ID NO: 5395 - RNA, 20 nt, Artificial Sequence
  spacer sequence
aauuccuucccuccuucccu

SEQ ID NO: 5396 - RNA, 20 nt, Artificial Sequence
  spacer sequence
uucccuccuucccuccuccc

SEQ ID NO: 5397 - RNA, 20 nt, Artificial Sequence
  spacer sequence
cuccuucccuccucccuuuc

SEQ ID NO: 5398 - RNA, 20 nt, Artificial Sequence
  spacer sequence
uucccuccucccuuucuucc

SEQ ID NO: 5399 - RNA, 20 nt, Artificial Sequence
  spacer sequence
cuccucccuuucuucccucc

SEQ ID NO: 5400 - RNA, 20 nt, Artificial Sequence
  spacer sequence
ucccuuucuucccucccucc

SEQ ID NO: 5401 - RNA, 20 nt, Artificial Sequence
  spacer sequence
cuuucuucccucccucccuc

SEQ ID NO: 5402 - RNA, 20 nt, Artificial Sequence
  spacer sequence
ucccucccucccuccuuccu

SEQ ID NO: 5403 - RNA, 20 nt, Artificial Sequence
  spacer sequence
cucccucccuccuuccuucu

SEQ ID NO: 5404 - RNA, 20 nt, Artificial Sequence
  spacer sequence
cucccuccuuccuucuucuu

SEQ ID NO: 5405 - RNA, 20 nt, Artificial Sequence
  spacer sequence
cuccuuccuucuucuuucuc

SEQ ID NO: 5406 - RNA, 20 nt, Artificial Sequence
  spacer sequence
uuccuucuucuuucucuuuc

SEQ ID NO: 5407 - RNA, 20 nt, Artificial Sequence
  spacer sequence
uucuucuuucucuuucuuuu

SEQ ID NO: 5408 - RNA, 20 nt, Artificial Sequence
  spacer sequence
ucuuucucuuucuuuuucuu

SEQ ID NO: 5409 - RNA, 20 nt, Artificial Sequence
  spacer sequence
uucucuuucuuuuucuuucu

SEQ ID NO: 5410 - RNA, 20 nt, Artificial Sequence
  spacer sequence
cuuucuuuuucuuucucucu

SEQ ID NO: 5411 - RNA, 20 nt, Artificial Sequence
  spacer sequence
uucuuuuucuuucucucuuu

SEQ ID NO: 5412 - RNA, 20 nt, Artificial Sequence
  spacer sequence
uuuucuuucucucuuucucu

SEQ ID NO: 5413 - RNA, 20 nt, Artificial Sequence
  spacer sequence
uucucucuuucucuuucuuu

SEQ ID NO: 5414 - RNA, 20 nt, Artificial Sequence
  spacer sequence
cucuuucucuuucuuucucu

SEQ ID NO: 5415 - RNA, 20 nt, Artificial Sequence
  spacer sequence
cuuucucuuucuuucucuuu

SEQ ID NO: 5416 - RNA, 20 nt, Artificial Sequence
  spacer sequence
uucucuuucuuucucuuucu

SEQ ID NO: 5417 - RNA, 20 nt, Artificial Sequence
  spacer sequence
cuuucuuucucuuucucucu

SEQ ID NO: 5418 - RNA, 20 nt, Artificial Sequence
  spacer sequence
uucuuucucuuucucucuca

SEQ ID NO: 5419 - RNA, 20 nt, Artificial Sequence
  spacer sequence
uucucuuucucucucacucu

SEQ ID NO: 5420 - RNA, 20 nt, Artificial Sequence
  spacer sequence
cuuucucucucacucucuuu

SEQ ID NO: 5421 - RNA, 20 nt, Artificial Sequence
  spacer sequence
uucucucucacucucuuuuc

SEQ ID NO: 5422 - RNA, 20 nt, Artificial Sequence
  spacer sequence
cucucacucucuuuucuucu

SEQ ID NO: 5423 - RNA, 20 nt, Artificial Sequence
  spacer sequence
cucacucucuuuucuucuuu

SEQ ID NO: 5424 - RNA, 20 nt, Artificial Sequence
  spacer sequence
cacucucuuuucuucuuucu

SEQ ID NO: 5425 - RNA, 20 nt, Artificial Sequence
  spacer sequence
cucucuuuucuucuuucuga

SEQ ID NO: 5426 - RNA, 20 nt, Artificial Sequence
  spacer sequence
cuuuucuucuuucugacagg

SEQ ID NO: 5427 - RNA, 20 nt, Artificial Sequence
  spacer sequence
uuucuucuuucugacagggu

SEQ ID NO: 5428 - RNA, 20 nt, Artificial Sequence
  spacer sequence
ucuuucugacaggguuugcc

SEQ ID NO: 5429 - RNA, 20 nt, Artificial Sequence
  spacer sequence
uucugacaggguuugccugu

SEQ ID NO: 5430 - RNA, 20 nt, Artificial Sequence
  spacer sequence
gacaggguuugccuguucug

SEQ ID NO: 5431 - RNA, 20 nt, Artificial Sequence
  spacer sequence
gaaagaagaaaagagaguga

SEQ ID NO: 5432 - RNA, 20 nt, Artificial Sequence
  spacer sequence
gcuucuuuaaacccuggggu

SEQ ID NO: 5433 - RNA, 20 nt, Artificial Sequence
  spacer sequence
uuaaacccugggguucaagu

SEQ ID NO: 5434 - RNA, 20 nt, Artificial Sequence
  spacer sequence
agugcaaaggucccucucau

SEQ ID NO: 5435 - RNA, 20 nt, Artificial Sequence
  spacer sequence
cucucaucugauuucccuau

SEQ ID NO: 5436 - RNA, 20 nt, Artificial Sequence
  spacer sequence
caucugauuucccuauuuua

SEQ ID NO: 5437 - RNA, 20 nt, Artificial Sequence
  spacer sequence
ucugauuucccuauuuuauu

SEQ ID NO: 5438 - RNA, 20 nt, Artificial Sequence
  spacer sequence
gauuucccuauuuuauuuua

SEQ ID NO: 5439 - RNA, 20 nt, Artificial Sequence
  spacer sequence
gaugagagggaccuuugcac

SEQ ID NO: 5440 - RNA, 20 nt, Artificial Sequence
  spacer sequence
cuauuuuauuuuauuuaagu

SEQ ID NO: 5441 - RNA, 20 nt, Artificial Sequence
  spacer sequence
aacuuaaauaaaauaaaaua

SEQ ID NO: 5442 - RNA, 20 nt, Artificial Sequence
  spacer sequence
acgaugaugaugaugauuau

SEQ ID NO: 5443 - RNA, 20 nt, Artificial Sequence
  spacer sequence
uggaguaucuaacuuaaaua

SEQ ID NO: 5444 - RNA, 20 nt, Artificial Sequence
  spacer sequence
ucguggaguaucuaacuuaa

SEQ ID NO: 5445 - RNA, 20 nt, Artificial Sequence
  spacer sequence
ucaucguggaguaucuaacu

SEQ ID NO: 5446 - RNA, 20 nt, Artificial Sequence
  spacer sequence
ucaucaucguggaguaucua

SEQ ID NO: 5447 - RNA, 20 nt, Artificial Sequence
  spacer sequence
ucaucaucaucguggaguau

SEQ ID NO: 5448 - RNA, 20 nt, Artificial Sequence
  spacer sequence
acaauaaucaucaucaucau

SEQ ID NO: 5449 - RNA, 20 nt, Artificial Sequence
  spacer sequence
caacaauaaucaucaucauc

SEQ ID NO: 5450 - RNA, 20 nt, Artificial Sequence
  spacer sequence
ugucucaacaauaaucauca

SEQ ID NO: 5451 - RNA, 20 nt, Artificial Sequence
  spacer sequence
uucuguugcccaggcuggag

SEQ ID NO: 5452 - RNA, 20 nt, Artificial Sequence
  spacer sequence
guugcccaggcuggagugca

SEQ ID NO: 5453 - RNA, 20 nt, Artificial Sequence
  spacer sequence
agccugggcaacagaaugaa

SEQ ID NO: 5454 - RNA, 20 nt, Artificial Sequence
  spacer sequence
caccauugcacuccagccug

SEQ ID NO: 5455 - RNA, 20 nt, Artificial Sequence
  spacer sequence
caacucacugcagccucaac

SEQ ID NO: 5456 - RNA, 20 nt, Artificial Sequence
  spacer sequence
cugcagccucaaccuccugg

SEQ ID NO: 5457 - RNA, 20 nt, Artificial Sequence
  spacer sequence
accuccugggcccacgcgau

SEQ ID NO: 5458 - RNA, 20 nt, Artificial Sequence
  spacer sequence
ugggcccacgcgauccuccu

SEQ ID NO: 5459 - RNA, 20 nt, Artificial Sequence
  spacer sequence
cgugggcccaggagguugag

SEQ ID NO: 5460 - RNA, 20 nt, Artificial Sequence
  spacer sequence
uccuaccucagccucccaag

SEQ ID NO: 5461 - RNA, 20 nt, Artificial Sequence
  spacer sequence
uaccucagccucccaaguag

SEQ ID NO: 5462 - RNA, 20 nt, Artificial Sequence
  spacer sequence
gccucccaaguagcuuggac

SEQ ID NO: 5463 - RNA, 20 nt, Artificial Sequence
  spacer sequence
caaguagcuuggacuacagg

SEQ ID NO: 5464 - RNA, 20 nt, Artificial Sequence
  spacer sequence
aagcuacuugggaggcugag

SEQ ID NO: 5465 - RNA, 20 nt, Artificial Sequence
  spacer sequence
ggcacauguaauuagccggg

SEQ ID NO: 5466 - RNA, 20 nt, Artificial Sequence
  spacer sequence
acccacguuccaggguucca

SEQ ID NO: 5467 - RNA, 20 nt, Artificial Sequence
  spacer sequence
aggguuccaaacaaccaagg

SEQ ID NO: 5468 - RNA, 20 nt, Artificial Sequence
  spacer sequence
aaacaaccaaggcucuauca

SEQ ID NO: 5469 - RNA, 20 nt, Artificial Sequence
  spacer sequence
aucauccugucuuaacaaau

SEQ ID NO: 5470 - RNA, 20 nt, Artificial Sequence
  spacer sequence
uccugucuuaacaaauauac

SEQ ID NO: 5471 - RNA, 20 nt, Artificial Sequence
  spacer sequence
ugucuuaacaaauauaccuu

SEQ ID NO: 5472 - RNA, 20 nt, Artificial Sequence
  spacer sequence
uaacaaauauaccuucauaa

SEQ ID NO: 5473 - RNA, 20 nt, Artificial Sequence
  spacer sequence
uaaagaccuggaaggcaggu

SEQ ID NO: 5474 - RNA, 20 nt, Artificial Sequence
  spacer sequence
uuaugaagguauauuuguua

SEQ ID NO: 5475 - RNA, 20 nt, Artificial Sequence
  spacer sequence
aggucuuuaugaagguauau

SEQ ID NO: 5476 - RNA, 20 nt, Artificial Sequence
  spacer sequence
accugccuuccaggucuuua

SEQ ID NO: 5477 - RNA, 20 nt, Artificial Sequence
  spacer sequence
acauuucaaccugccuucca

SEQ ID NO: 5478 - RNA, 20 nt, Artificial Sequence
  spacer sequence
uggacuucuuucaguucuac

SEQ ID NO: 5479 - RNA, 20 nt, Artificial Sequence
  spacer sequence
aagaauuccacauuucaacc

SEQ ID NO: 5480 - RNA, 20 nt, Artificial Sequence
  spacer sequence
uucaguucuacguagaaggg

SEQ ID NO: 5481 - RNA, 20 nt, Artificial Sequence
  spacer sequence
guucuacguagaaggguagc

SEQ ID NO: 5482 - RNA, 20 nt, Artificial Sequence
  spacer sequence
acguagaaggguagcagugg

SEQ ID NO: 5483 - RNA, 20 nt, Artificial Sequence
  spacer sequence
acguagaacugaaagaaguc

SEQ ID NO: 5484 - RNA, 20 nt, Artificial Sequence
  spacer sequence
acugcuacccuucuacguag

SEQ ID NO: 5485 - RNA, 20 nt, Artificial Sequence
  spacer sequence
ccacugcuacccuucuacgu

SEQ ID NO: 5486 - RNA, 20 nt, Artificial Sequence
  spacer sequence
uccuuuccccaccccugcuc

SEQ ID NO: 5487 - RNA, 20 nt, Artificial Sequence
  spacer sequence
uuuccccaccccugcuccuu

SEQ ID NO: 5488 - RNA, 20 nt, Artificial Sequence
  spacer sequence
ccaccccugcuccuuguggc

SEQ ID NO: 5489 - RNA, 20 nt, Artificial Sequence
  spacer sequence
uuguggcacugggcagggcc

SEQ ID NO: 5490 - RNA, 20 nt, Artificial Sequence
  spacer sequence
aggcuagcaguguacucaac

SEQ ID NO: 5491 - RNA, 20 nt, Artificial Sequence
  spacer sequence
acaagggacagucccugugu

SEQ ID NO: 5492 - RNA, 20 nt, Artificial Sequence
  spacer sequence
cuuguugaguacacugcuag

SEQ ID NO: 5493 - RNA, 20 nt, Artificial Sequence
  spacer sequence
cuguguggccuguucaggau

SEQ ID NO: 5494 - RNA, 20 nt, Artificial Sequence
  spacer sequence
ggauccuauacacaggcuca

SEQ ID NO: 5495 - RNA, 20 nt, Artificial Sequence
  spacer sequence
ugaacaggccacacagggac

SEQ ID NO: 5496 - RNA, 20 nt, Artificial Sequence
  spacer sequence
uauacacaggcucagggcuc

SEQ ID NO: 5497 - RNA, 20 nt, Artificial Sequence
  spacer sequence
gggcucuuugggcaggaaau

SEQ ID NO: 5498 - RNA, 20 nt, Artificial Sequence
  spacer sequence
uugggcaggaaauuccagga

SEQ ID NO: 5499 - RNA, 20 nt, Artificial Sequence
  spacer sequence
ugcccaaagagcccugagcc

SEQ ID NO: 5500 - RNA, 20 nt, Artificial Sequence
  spacer sequence
aggauccggguacucaagug

SEQ ID NO: 5501 - RNA, 20 nt, Artificial Sequence
  spacer sequence
uggaauuuccugcccaaaga

SEQ ID NO: 5502 - RNA, 20 nt, Artificial Sequence
  spacer sequence
ggguacucaagugguguucu

SEQ ID NO: 5503 - RNA, 20 nt, Artificial Sequence
  spacer sequence
agugguguucuaaacagugg

SEQ ID NO: 5504 - RNA, 20 nt, Artificial Sequence
  spacer sequence
aaacagugguucuuggccgg

SEQ ID NO: 5505 - RNA, 20 nt, Artificial Sequence
  spacer sequence
uggccgggugugguggcuca

SEQ ID NO: 5506 - RNA, 20 nt, Artificial Sequence
  spacer sequence
caccuguaaucccagcacuu

SEQ ID NO: 5507 - RNA, 20 nt, Artificial Sequence
  spacer sequence
cagcacuuugggaggccgag

SEQ ID NO: 5508 - RNA, 20 nt, Artificial Sequence
  spacer sequence
caaagugcugggauuacagg

SEQ ID NO: 5509 - RNA, 20 nt, Artificial Sequence
  spacer sequence
gccucccaaagugcugggau

SEQ ID NO: 5510 - RNA, 20 nt, Artificial Sequence
  spacer sequence
gccagccucggccucccaaa

SEQ ID NO: 5511 - RNA, 20 nt, Artificial Sequence
  spacer sequence
cuugaggucaggaguucgag

SEQ ID NO: 5512 - RNA, 20 nt, Artificial Sequence
  spacer sequence
agugaucugccagccucggc

SEQ ID NO: 5513 - RNA, 20 nt, Artificial Sequence
  spacer sequence
ggaguucgagaccagccugg

SEQ ID NO: 5514 - RNA, 20 nt, Artificial Sequence
  spacer sequence
ugaccucaagugaucugcca

SEQ ID NO: 5515 - RNA, 20 nt, Artificial Sequence
  spacer sequence
agaccagccuggccaacaug

SEQ ID NO: 5516 - RNA, 20 nt, Artificial Sequence
  spacer sequence
aacuccugaccucaagugau

SEQ ID NO: 5517 - RNA, 20 nt, Artificial Sequence
  spacer sequence
cgaacuccugaccucaagug

SEQ ID NO: 5518 - RNA, 20 nt, Artificial Sequence
  spacer sequence
ccauguuggccaggcugguc

SEQ ID NO: 5519 - RNA, 20 nt, Artificial Sequence
  spacer sequence
cuacuaaaaauacaaaaacu

SEQ ID NO: 5520 - RNA, 20 nt, Artificial Sequence
  spacer sequence
acuaaaaauacaaaaacuua

SEQ ID NO: 5521 - RNA, 20 nt, Artificial Sequence
  spacer sequence
cagcuacucgggaggcugag

SEQ ID NO: 5522 - RNA, 20 nt, Artificial Sequence
  spacer sequence
ggaggcugaggcaggagaau

SEQ ID NO: 5523 - RNA, 20 nt, Artificial Sequence
  spacer sequence
cgaguagcugggacuacagg

SEQ ID NO: 5524 - RNA, 20 nt, Artificial Sequence
  spacer sequence
gccucccgaguagcugggac

SEQ ID NO: 5525 - RNA, 20 nt, Artificial Sequence
  spacer sequence
ugccucagccucccgaguag

SEQ ID NO: 5526 - RNA, 20 nt, Artificial Sequence
  spacer sequence
ccugccucagccucccgagu

SEQ ID NO: 5527 - RNA, 20 nt, Artificial Sequence
  spacer sequence
cuugaacccagcaggcggag

SEQ ID NO: 5528 - RNA, 20 nt, Artificial Sequence
  spacer sequence
agugauucuccugccucagc

SEQ ID NO: 5529 - RNA, 20 nt, Artificial Sequence
  spacer sequence
gccugcuggguucaagugau

SEQ ID NO: 5530 - RNA, 20 nt, Artificial Sequence
  spacer sequence
cugcaaccuccgccugcugg

SEQ ID NO: 5531 - RNA, 20 nt, Artificial Sequence
  spacer sequence
gcucacugcaaccuccgccu

SEQ ID NO: 5532 - RNA, 20 nt, Artificial Sequence
  spacer sequence
cagcucacugcaaccuccgc

SEQ ID NO: 5533 - RNA, 20 nt, Artificial Sequence
  spacer sequence
agccuggugacagagugaga

SEQ ID NO: 5534 - RNA, 20 nt, Artificial Sequence
  spacer sequence
ccaggcuggagugcaguggu

SEQ ID NO: 5535 - RNA, 20 nt, Artificial Sequence
  spacer sequence
gucaccaggcuggagugcag

SEQ ID NO: 5536 - RNA, 20 nt, Artificial Sequence
  spacer sequence
cucugucaccaggcuggagu

SEQ ID NO: 5537 - RNA, 20 nt, Artificial Sequence
  spacer sequence
cacucugucaccaggcugga

SEQ ID NO: 5538 - RNA, 20 nt, Artificial Sequence
  spacer sequence
auaucaaaauaaauacauaa

SEQ ID NO: 5539 - RNA, 20 nt, Artificial Sequence
  spacer sequence
aaauaaauacauaaauaaau

SEQ ID NO: 5540 - RNA, 20 nt, Artificial Sequence
  spacer sequence
cuguuuuuauuuauuuaugu

SEQ ID NO: 5541 - RNA, 20 nt, Artificial Sequence
  spacer sequence
uaacugggagugauuuggca

SEQ ID NO: 5542 - RNA, 20 nt, Artificial Sequence
  spacer sequence
caguuaagaaucacuguuuu

SEQ ID NO: 5543 - RNA, 20 nt, Artificial Sequence
  spacer sequence
cucccaguuaagaaucacug

SEQ ID NO: 5544 - RNA, 20 nt, Artificial Sequence
  spacer sequence
ggaauuauuuuugguuaucc

SEQ ID NO: 5545 - RNA, 20 nt, Artificial Sequence
  spacer sequence
agacguugccaaaucacucc

SEQ ID NO: 5546 - RNA, 20 nt, Artificial Sequence
  spacer sequence
cagccuggcagggagggaca

SEQ ID NO: 5547 - RNA, 20 nt, Artificial Sequence
  spacer sequence
cugccaggcugggauaacca

SEQ ID NO: 5548 - RNA, 20 nt, Artificial Sequence
  spacer sequence
cucccugccaggcugggaua

SEQ ID NO: 5549 - RNA, 20 nt, Artificial Sequence
  spacer sequence
agugaguaggggcuagggau

SEQ ID NO: 5550 - RNA, 20 nt, Artificial Sequence
  spacer sequence
cuagaugccaguaauacccu

SEQ ID NO: 5551 - RNA, 20 nt, Artificial Sequence
  spacer sequence
cuagccccuacucacuagau

SEQ ID NO: 5552 - RNA, 20 nt, Artificial Sequence
  spacer sequence
acugaacauccuacagugua

SEQ ID NO: 5553 - RNA, 20 nt, Artificial Sequence
  spacer sequence
guagaaucccuagccccuac

SEQ ID NO: 5554 - RNA, 20 nt, Artificial Sequence
  spacer sequence
uacaguguacaggacagccu

SEQ ID NO: 5555 - RNA, 20 nt, Artificial Sequence
  spacer sequence
uguacacuguaggauguuca

SEQ ID NO: 5556 - RNA, 20 nt, Artificial Sequence
  spacer sequence
acagcaaagaacugucuggc

SEQ ID NO: 5557 - RNA, 20 nt, Artificial Sequence
  spacer sequence
uugcuguggaggcuguccug

SEQ ID NO: 5558 - RNA, 20 nt, Artificial Sequence
  spacer sequence
ggcccaaaauguccauagug

SEQ ID NO: 5559 - RNA, 20 nt, Artificial Sequence
  spacer sequence
auagugcccacauucgaugc

SEQ ID NO: 5560 - RNA, 20 nt, Artificial Sequence
  spacer sequence
augcccugcauuaggaagau

SEQ ID NO: 5561 - RNA, 20 nt, Artificial Sequence
  spacer sequence
aaugugggcacuauggacau

SEQ ID NO: 5562 - RNA, 20 nt, Artificial Sequence
  spacer sequence
uaaugcagggcaucgaaugu

SEQ ID NO: 5563 - RNA, 20 nt, Artificial Sequence
  spacer sequence
uccuaaugcagggcaucgaa

SEQ ID NO: 5564 - RNA, 20 nt, Artificial Sequence
  spacer sequence
uaaauaucacagaguuaaau

SEQ ID NO: 5565 - RNA, 20 nt, Artificial Sequence
  spacer sequence
cagaguuaaauuccuuaccc

SEQ ID NO: 5566 - RNA, 20 nt, Artificial Sequence
  spacer sequence
gugauauuuaagaguauuua

SEQ ID NO: 5567 - RNA, 20 nt, Artificial Sequence
  spacer sequence
uuaccccuguucuagcagag

SEQ ID NO: 5568 - RNA, 20 nt, Artificial Sequence
  spacer sequence
agcagagaugauauucuugc

SEQ ID NO: 5569 - RNA, 20 nt, Artificial Sequence
  spacer sequence
gcuagaacagggguaaggaa

SEQ ID NO: 5570 - RNA, 20 nt, Artificial Sequence
  spacer sequence
cugcuagaacagggguaagg

SEQ ID NO: 5571 - RNA, 20 nt, Artificial Sequence
  spacer sequence
ucucugcuagaacaggggua

SEQ ID NO: 5572 - RNA, 20 nt, Artificial Sequence
  spacer sequence
ugcggggggagcaucuucuu

SEQ ID NO: 5573 - RNA, 20 nt, Artificial Sequence
  spacer sequence
ccccgcaagaauaucaucuc

SEQ ID NO: 5574 - RNA, 20 nt, Artificial Sequence
  spacer sequence
ucuuggcuucaacacauucu

SEQ ID NO: 5575 - RNA, 20 nt, Artificial Sequence
  spacer sequence
uggcuucaacacauucuuuu

SEQ ID NO: 5576 - RNA, 20 nt, Artificial Sequence
  spacer sequence
acacauucuuuucuccaugg

SEQ ID NO: 5577 - RNA, 20 nt, Artificial Sequence
  spacer sequence
uuucuccaugggagaugaug

SEQ ID NO: 5578 - RNA, 20 nt, Artificial Sequence
  spacer sequence
ccaugggagaugaugccaga

SEQ ID NO: 5579 - RNA, 20 nt, Artificial Sequence
  spacer sequence
augggagaugaugccagaag

SEQ ID NO: 5580 - RNA, 20 nt, Artificial Sequence
  spacer sequence
cauggagaaaagaauguguu

SEQ ID NO: 5581 - RNA, 20 nt, Artificial Sequence
  spacer sequence
cccauggagaaaagaaugug

SEQ ID NO: 5582 - RNA, 20 nt, Artificial Sequence
  spacer sequence
ucucccauggagaaaagaau

SEQ ID NO: 5583 - RNA, 20 nt, Artificial Sequence
  spacer sequence
ggcaucaucucccauggaga

SEQ ID NO: 5584 - RNA, 20 nt, Artificial Sequence
  spacer sequence
ucuggcaucaucucccaugg

SEQ ID NO: 5585 - RNA, 20 nt, Artificial Sequence
  spacer sequence
cucuucuggcaucaucuccc

SEQ ID NO: 5586 - RNA, 20 nt, Artificial Sequence
  spacer sequence
gucccucuucuggcaucauc

SEQ ID NO: 5587 - RNA, 20 nt, Artificial Sequence
  spacer sequence
cuggccccaggccccaugcu

SEQ ID NO: 5588 - RNA, 20 nt, Artificial Sequence
  spacer sequence
ggugugacgaccauccuacg

SEQ ID NO: 5589 - RNA, 20 nt, Artificial Sequence
  spacer sequence
caccugaacaaggggguccc

SEQ ID NO: 5590 - RNA, 20 nt, Artificial Sequence
  spacer sequence
ucacaccugaacaagggggu

SEQ ID NO: 5591 - RNA, 20 nt, Artificial Sequence
  spacer sequence
uacgaaggcaccacccaggc

SEQ ID NO: 5592 - RNA, 20 nt, Artificial Sequence
  spacer sequence
uaggauggucgucacaccug

SEQ ID NO: 5593 - RNA, 20 nt, Artificial Sequence
  spacer sequence
uuagaccgucucaaaagaag

SEQ ID NO: 5594 - RNA, 20 nt, Artificial Sequence
  spacer sequence
aaugaugccuggguggugcc

SEQ ID NO: 5595 - RNA, 20 nt, Artificial Sequence
  spacer sequence
caaaagaagaguaauucacu

SEQ ID NO: 5596 - RNA, 20 nt, Artificial Sequence
  spacer sequence
aaagaagaguaauucacugu

SEQ ID NO: 5597 - RNA, 20 nt, Artificial Sequence
  spacer sequence
uuugagacggucuaaugaug

SEQ ID NO: 5598 - RNA, 20 nt, Artificial Sequence
  spacer sequence
ucuuuugagacggucuaaug

SEQ ID NO: 5599 - RNA, 20 nt, Artificial Sequence
  spacer sequence
cugucccaaagcagcucucu

SEQ ID NO: 5600 - RNA, 20 nt, Artificial Sequence
  spacer sequence
caaagcagcucucucguguc

SEQ ID NO: 5601 - RNA, 20 nt, Artificial Sequence
  spacer sequence
cucgugucugugggcggauc

SEQ ID NO: 5602 - RNA, 20 nt, Artificial Sequence
  spacer sequence
cgugucugugggcggauccc

SEQ ID NO: 5603 - RNA, 20 nt, Artificial Sequence
  spacer sequence
ugucugugggcggaucccuu

SEQ ID NO: 5604 - RNA, 20 nt, Artificial Sequence
  spacer sequence
gugggcggaucccuuggcaa

SEQ ID NO: 5605 - RNA, 20 nt, Artificial Sequence
  spacer sequence
gcccacagacacgagagagc

SEQ ID NO: 5606 - RNA, 20 nt, Artificial Sequence
  spacer sequence
cuuggcaaguuuacaaugaa

SEQ ID NO: 5607 - RNA, 20 nt, Artificial Sequence
  spacer sequence
uuguaaacuugccaagggau

SEQ ID NO: 5608 - RNA, 20 nt, Artificial Sequence
  spacer sequence
guucauuguaaacuugccaa

SEQ ID NO: 5609 - RNA, 20 nt, Artificial Sequence
  spacer sequence
gccgaacuuccuggaaccca

SEQ ID NO: 5610 - RNA, 20 nt, Artificial Sequence
  spacer sequence
gcagauuucaguucauugua

SEQ ID NO: 5611 - RNA, 20 nt, Artificial Sequence
  spacer sequence
uggaacccaaagaaacuuua

SEQ ID NO: 5612 - RNA, 20 nt, Artificial Sequence
  spacer sequence
aggaaguucggcagauuuca

SEQ ID NO: 5613 - RNA, 20 nt, Artificial Sequence
  spacer sequence
uuggguuccaggaaguucgg

SEQ ID NO: 5614 - RNA, 20 nt, Artificial Sequence
  spacer sequence
aaacgguugcauaaacagug

SEQ ID NO: 5615 - RNA, 20 nt, Artificial Sequence
  spacer sequence
uauauucuaaacgguugcau

SEQ ID NO: 5616 - RNA, 20 nt, Artificial Sequence
  spacer sequence
ggagacuacuaccaaauaca

SEQ ID NO: 5617 - RNA, 20 nt, Artificial Sequence
  spacer sequence
agauaauucguauauucuaa

SEQ ID NO: 5618 - RNA, 20 nt, Artificial Sequence
  spacer sequence
ccagauaauucguauauucu

SEQ ID NO: 5619 - RNA, 20 nt, Artificial Sequence
  spacer sequence
uagaggaugauaaaaaaaug

SEQ ID NO: 5620 - RNA, 20 nt, Artificial Sequence
  spacer sequence
aggaaguauacauauuugca

SEQ ID NO: 5621 - RNA, 20 nt, Artificial Sequence
  spacer sequence
ucuaggaaguauacauauuu

SEQ ID NO: 5622 - RNA, 20 nt, Artificial Sequence
  spacer sequence
uccucuaggaaguauacaua

SEQ ID NO: 5623 - RNA, 20 nt, Artificial Sequence
  spacer sequence
cauuuuuuuaucauccucua

SEQ ID NO: 5624 - RNA, 20 nt, Artificial Sequence
  spacer sequence
cugauagaggaugcauuaga

SEQ ID NO: 5625 - RNA, 20 nt, Artificial Sequence
  spacer sequence
gauagaggaugcauuagagu

SEQ ID NO: 5626 - RNA, 20 nt, Artificial Sequence
  spacer sequence
gagaaauacaauucacauuu

SEQ ID NO: 5627 - RNA, 20 nt, Artificial Sequence
  spacer sequence
aucagagaaauacaauucac

SEQ ID NO: 5628 - RNA, 20 nt, Artificial Sequence
  spacer sequence
ucuaucagagaaauacaauu

SEQ ID NO: 5629 - RNA, 20 nt, Artificial Sequence
  spacer sequence
aaugcauccucuaucagaga

SEQ ID NO: 5630 - RNA, 20 nt, Artificial Sequence
  spacer sequence
gagggucuaaauagcguaaa

SEQ ID NO: 5631 - RNA, 20 nt, Artificial Sequence
  spacer sequence
gacucuaaugcauccucuau

SEQ ID NO: 5632 - RNA, 20 nt, Artificial Sequence
  spacer sequence
aaauagcguaaauaauaaau

SEQ ID NO: 5633 - RNA, 20 nt, Artificial Sequence
  spacer sequence
auaguaguguacuccaaacg

SEQ ID NO: 5634 - RNA, 20 nt, Artificial Sequence
  spacer sequence
auuuauuuacuuauuuauua

SEQ ID NO: 5635 - RNA, 20 nt, Artificial Sequence
  spacer sequence
aaacgaggcuggaauagcuu

SEQ ID NO: 5636 - RNA, 20 nt, Artificial Sequence
  spacer sequence
uuuggaguacacuacuaucg

SEQ ID NO: 5637 - RNA, 20 nt, Artificial Sequence
  spacer sequence
agccucguuuggaguacacu

SEQ ID NO: 5638 - RNA, 20 nt, Artificial Sequence
  spacer sequence
auuguuguuucacacuggac

SEQ ID NO: 5639 - RNA, 20 nt, Artificial Sequence
  spacer sequence
cacuggacuucaauuaaguc

SEQ ID NO: 5640 - RNA, 20 nt, Artificial Sequence
  spacer sequence
agugugaaacaacaauagaa

SEQ ID NO: 5641 - RNA, 20 nt, Artificial Sequence
  spacer sequence
auuaagucucaguauuuugc

SEQ ID NO: 5642 - RNA, 20 nt, Artificial Sequence
  spacer sequence
caguauuuugccauacucaa

SEQ ID NO: 5643 - RNA, 20 nt, Artificial Sequence
  spacer sequence
guauuuugccauacucaaua

SEQ ID NO: 5644 - RNA, 20 nt, Artificial Sequence
  spacer sequence
auauuaaguacuaggcugga

SEQ ID NO: 5645 - RNA, 20 nt, Artificial Sequence
  spacer sequence
agccuaguacuuaauauuga

SEQ ID NO: 5646 - RNA, 20 nt, Artificial Sequence
  spacer sequence
ugucuguaaucccagcacuu

SEQ ID NO: 5647 - RNA, 20 nt, Artificial Sequence
  spacer sequence
guaaucccagcacuuuggga

SEQ ID NO: 5648 - RNA, 20 nt, Artificial Sequence
  spacer sequence
cagcacuuugggaggccgag

SEQ ID NO: 5649 - RNA, 20 nt, Artificial Sequence
  spacer sequence
caaagugcugggauuacaga

SEQ ID NO: 5650 - RNA, 20 nt, Artificial Sequence
  spacer sequence
gccucccaaagugcugggau

SEQ ID NO: 5651 - RNA, 20 nt, Artificial Sequence
  spacer sequence
acccaccucggccucccaaa

SEQ ID NO: 5652 - RNA, 20 nt, Artificial Sequence
  spacer sequence
agccagccaucuacccaccu

SEQ ID NO: 5653 - RNA, 20 nt, Artificial Sequence
  spacer sequence
ggaguuugaaaccagccugg

SEQ ID NO: 5654 - RNA, 20 nt, Artificial Sequence
  spacer sequence
ugagcucaagccagccaucu

SEQ ID NO: 5655 - RNA, 20 nt, Artificial Sequence
  spacer sequence
aacuccugagcucaagccag

SEQ ID NO: 5656 - RNA, 20 nt, Artificial Sequence
  spacer sequence
guacccaaaauacaaaaauc

SEQ ID NO: 5657 - RNA, 20 nt, Artificial Sequence
  spacer sequence
gccaggugugguggcacaug

SEQ ID NO: 5658 - RNA, 20 nt, Artificial Sequence
  spacer sequence
cagguacuugggaggcugag

SEQ ID NO: 5659 - RNA, 20 nt, Artificial Sequence
  spacer sequence
caaguaccugggaccacagg

SEQ ID NO: 5660 - RNA, 20 nt, Artificial Sequence
  spacer sequence
gccucccaaguaccugggac

SEQ ID NO: 5661 - RNA, 20 nt, Artificial Sequence
  spacer sequence
ugccucagccucccaaguac

SEQ ID NO: 5662 - RNA, 20 nt, Artificial Sequence
  spacer sequence
uccugccucagccucccaag

SEQ ID NO: 5663 - RNA, 20 nt, Artificial Sequence
  spacer sequence
agccauccuccugccucagc

SEQ ID NO: 5664 - RNA, 20 nt, Artificial Sequence
  spacer sequence
uggguucaagccauccuccu

SEQ ID NO: 5665 - RNA, 20 nt, Artificial Sequence
  spacer sequence
accuccuggguucaagccau

SEQ ID NO: 5666 - RNA, 20 nt, Artificial Sequence
  spacer sequence
cugcagccuccaccuccugg

SEQ ID NO: 5667 - RNA, 20 nt, Artificial Sequence
  spacer sequence
uagcucacugcagccuccac

SEQ ID NO: 5668 - RNA, 20 nt, Artificial Sequence
  spacer sequence
agccugggugacagagcgag

SEQ ID NO: 5669 - RNA, 20 nt, Artificial Sequence
  spacer sequence
cccaggcuggagugcagugg

SEQ ID NO: 5670 - RNA, 20 nt, Artificial Sequence
  spacer sequence
gucacccaggcuggagugca

SEQ ID NO: 5671 - RNA, 20 nt, Artificial Sequence
  spacer sequence
cucugucacccaggcuggag

SEQ ID NO: 5672 - RNA, 20 nt, Artificial Sequence
  spacer sequence
cgcucugucacccaggcugg

SEQ ID NO: 5673 - RNA, 20 nt, Artificial Sequence
  spacer sequence
caaaaaucaaacaaacaacc

SEQ ID NO: 5674 - RNA, 20 nt, Artificial Sequence
  spacer sequence
aaaaucaaacaaacaacccc

SEQ ID NO: 5675 - RNA, 20 nt, Artificial Sequence
  spacer sequence
aacaaacaacccccucgccc

SEQ ID NO: 5676 - RNA, 20 nt, Artificial Sequence
  spacer sequence
ccccggacaaaaguaguuug

SEQ ID NO: 5677 - RNA, 20 nt, Artificial Sequence
  spacer sequence
ggggcgaggggguuguuugu

SEQ ID NO: 5678 - RNA, 20 nt, Artificial Sequence
  spacer sequence
cauuucacaauauguuuuug

SEQ ID NO: 5679 - RNA, 20 nt, Artificial Sequence
  spacer sequence
uuucacaauauguuuuugaa

SEQ ID NO: 5680 - RNA, 20 nt, Artificial Sequence
  spacer sequence
caauauguuuuugaaauauu

SEQ ID NO: 5681 - RNA, 20 nt, Artificial Sequence
  spacer sequence
aaaacauauugugaaaugag

SEQ ID NO: 5682 - RNA, 20 nt, Artificial Sequence
  spacer sequence
cuugaaagguaagucauauu

SEQ ID NO: 5683 - RNA, 20 nt, Artificial Sequence
  spacer sequence
agggaaauauuucaaaaaca

SEQ ID NO: 5684 - RNA, 20 nt, Artificial Sequence
  spacer sequence
uauuuaucauuccuguugua

SEQ ID NO: 5685 - RNA, 20 nt, Artificial Sequence
  spacer sequence
uuccuguuguauggaggcau

SEQ ID NO: 5686 - RNA, 20 nt, Artificial Sequence
  spacer sequence
uguuguauggaggcaucaua

SEQ ID NO: 5687 - RNA, 20 nt, Artificial Sequence
  spacer sequence
auacaacaggaaugauaaau

SEQ ID NO: 5688 - RNA, 20 nt, Artificial Sequence
  spacer sequence
uaaauuauuucaccauucua

SEQ ID NO: 5689 - RNA, 20 nt, Artificial Sequence
  spacer sequence
ccauucuacccuccuugagu

SEQ ID NO: 5690 - RNA, 20 nt, Artificial Sequence
  spacer sequence
acccuccuugaguguugugg

SEQ ID NO: 5691 - RNA, 20 nt, Artificial Sequence
  spacer sequence
uugaguguuguggccuuuag

SEQ ID NO: 5692 - RNA, 20 nt, Artificial Sequence
  spacer sequence
aggaggguagaauggugaaa

SEQ ID NO: 5693 - RNA, 20 nt, Artificial Sequence
  spacer sequence
ggccuaaaggccacaacacu

SEQ ID NO: 5694 - RNA, 20 nt, Artificial Sequence
  spacer sequence
ccugcguuuuugucuggccu

SEQ ID NO: 5695 - RNA, 20 nt, Artificial Sequence
  spacer sequence
aggcaucaccugcguuuuug

SEQ ID NO: 5696 - RNA, 20 nt, Artificial Sequence
  spacer sequence
guaggguuguggccuugcca

SEQ ID NO: 5697 - RNA, 20 nt, Artificial Sequence
  spacer sequence
uguuuggcaaggccacaacc

SEQ ID NO: 5698 - RNA, 20 nt, Artificial Sequence
  spacer sequence
uuuuauauuuuuccuguuug

SEQ ID NO: 5699 - RNA, 20 nt, Artificial Sequence
  spacer sequence
guauucuuuuuauauuuuuc

SEQ ID NO: 5700 - RNA, 20 nt, Artificial Sequence
  spacer sequence
gccaaccaaauaagaaacuc

SEQ ID NO: 5701 - RNA, 20 nt, Artificial Sequence
  spacer sequence
uauuugguuggcagaauucg

SEQ ID NO: 5702 - RNA, 20 nt, Artificial Sequence
  spacer sequence
auacuaaggacuaagaaaau

SEQ ID NO: 5703 - RNA, 20 nt, Artificial Sequence
  spacer sequence
uuaguauagaguuucuuauu

SEQ ID NO: 5704 - RNA, 20 nt, Artificial Sequence
  spacer sequence
uaguccuuaguauagaguuu

SEQ ID NO: 5705 - RNA, 20 nt, Artificial Sequence
  spacer sequence
ccugcaauuuucuuaguccu

SEQ ID NO: 5706 - RNA, 20 nt, Artificial Sequence
  spacer sequence
uccccugcaauuuucuuagu

SEQ ID NO: 5707 - RNA, 20 nt, Artificial Sequence
  spacer sequence
cgggauugagguguagcgac

SEQ ID NO: 5708 - RNA, 20 nt, Artificial Sequence
  spacer sequence
cgggacuuaccuuuucuucc

SEQ ID NO: 5709 - RNA, 20 nt, Artificial Sequence
  spacer sequence
aucccgggacuuaccuuuuc

SEQ ID NO: 5710 - RNA, 20 nt, Artificial Sequence
  spacer sequence
cuacaccucaaucccgggac

SEQ ID NO: 5711 - RNA, 20 nt, Artificial Sequence
  spacer sequence
auacccucagaaaacuaaaa

SEQ ID NO: 5712 - RNA, 20 nt, Artificial Sequence
  spacer sequence
gaaaacuaaaaaacaagaca

SEQ ID NO: 5713 - RNA, 20 nt, Artificial Sequence
  spacer sequence
gaggguauagaaagucgcua

SEQ ID NO: 5714 - RNA, 20 nt, Artificial Sequence
  spacer sequence
uguuuuuuaguuuucugagg

SEQ ID NO: 5715 - RNA, 20 nt, Artificial Sequence
  spacer sequence
uuuuuuugucuuguuuuuua

SEQ ID NO: 5716 - RNA, 20 nt, Artificial Sequence
  spacer sequence
aucuuggggcgucccaauug

SEQ ID NO: 5717 - RNA, 20 nt, Artificial Sequence
  spacer sequence
uggggcgucccaauugcuga

SEQ ID NO: 5718 - RNA, 20 nt, Artificial Sequence
  spacer sequence
caauugcugaguaacaaaug

SEQ ID NO: 5719 - RNA, 20 nt, Artificial Sequence
  spacer sequence
gcaauugggacgccccaaga

SEQ ID NO: 5720 - RNA, 20 nt, Artificial Sequence
  spacer sequence
uuuguuacucagcaauuggg

SEQ ID NO: 5721 - RNA, 20 nt, Artificial Sequence
  spacer sequence
cauuuguuacucagcaauug

SEQ ID NO: 5722 - RNA, 20 nt, Artificial Sequence
  spacer sequence
gucauaacuaaugacauuuc

SEQ ID NO: 5723 - RNA, 20 nt, Artificial Sequence
  spacer sequence
uaacuaaugacauuucuaga

SEQ ID NO: 5724 - RNA, 20 nt, Artificial Sequence
  spacer sequence
uuaguuaugacugaguuugg

SEQ ID NO: 5725 - RNA, 20 nt, Artificial Sequence
  spacer sequence
agacaaagugacuucagauu

SEQ ID NO: 5726 - RNA, 20 nt, Artificial Sequence
  spacer sequence
agaaaugucauuaguuauga

SEQ ID NO: 5727 - RNA, 20 nt, Artificial Sequence
  spacer sequence
cuuugucuagaaaugucauu

SEQ ID NO: 5728 - RNA, 20 nt, Artificial Sequence
  spacer sequence
gauuuucaaagcguacccug

SEQ ID NO: 5729 - RNA, 20 nt, Artificial Sequence
  spacer sequence
gaagucacuuugucuagaaa

SEQ ID NO: 5730 - RNA, 20 nt, Artificial Sequence
  spacer sequence
aagcguacccuguuuacauc

SEQ ID NO: 5731 - RNA, 20 nt, Artificial Sequence
  spacer sequence
uuuugccaauuucgcguacu

SEQ ID NO: 5732 - RNA, 20 nt, Artificial Sequence
  spacer sequence
cguacugcaaccggcgggcc

SEQ ID NO: 5733 - RNA, 20 nt, Artificial Sequence
  spacer sequence
cgggggcguggcccgccggu

SEQ ID NO: 5734 - RNA, 20 nt, Artificial Sequence
  spacer sequence
uuucacgggggcguggcccg

SEQ ID NO: 5735 - RNA, 20 nt, Artificial Sequence
  spacer sequence
ccacauuucgggguucugga

SEQ ID NO: 5736 - RNA, 20 nt, Artificial Sequence
  spacer sequence
acauuucgggguucuggacg

SEQ ID NO: 5737 - RNA, 20 nt, Artificial Sequence
  spacer sequence
ggguucuggacguuucccgg

SEQ ID NO: 5738 - RNA, 20 nt, Artificial Sequence
  spacer sequence
ggacguuucccggcugcggg

SEQ ID NO: 5739 - RNA, 20 nt, Artificial Sequence
  spacer sequence
agaaccccgaaauguggaga

SEQ ID NO: 5740 - RNA, 20 nt, Artificial Sequence
  spacer sequence
cggcugcggggcggggggag

SEQ ID NO: 5741 - RNA, 20 nt, Artificial Sequence
  spacer sequence
ccccgccccgcagccgggaa

SEQ ID NO: 5742 - RNA, 20 nt, Artificial Sequence
  spacer sequence
ccggcgcacgcggccccuug

SEQ ID NO: 5743 - RNA, 20 nt, Artificial Sequence
  spacer sequence
ggcgcacgcggccccuuggc

SEQ ID NO: 5744 - RNA, 20 nt, Artificial Sequence
  spacer sequence
uucccggccacucgcgaccc

SEQ ID NO: 5745 - RNA, 20 nt, Artificial Sequence
  spacer sequence
cggccacucgcgacccgagg

SEQ ID NO: 5746 - RNA, 20 nt, Artificial Sequence
  spacer sequence
cgacccgaggcugccgcagg

SEQ ID NO: 5747 - RNA, 20 nt, Artificial Sequence
  spacer sequence
cgaguggccgggaaugacug

SEQ ID NO: 5748 - RNA, 20 nt, Artificial Sequence
  spacer sequence
ggucgcgaguggccgggaau

SEQ ID NO: 5749 - RNA, 20 nt, Artificial Sequence
  spacer sequence
gcccgcccccugcggcagcc

SEQ ID NO: 5750 - RNA, 20 nt, Artificial Sequence
  spacer sequence
cacgcgcucagcccgccccc

SEQ ID NO: 5751 - RNA, 20 nt, Artificial Sequence
  spacer sequence
ccucgcacgcgcucagcccg

SEQ ID NO: 5752 - RNA, 20 nt, Artificial Sequence
  spacer sequence
ggccccaaaccaaucgccuc

SEQ ID NO: 5753 - RNA, 20 nt, Artificial Sequence
  spacer sequence
cccacucuggccccaaacca

SEQ ID NO: 5754 - RNA, 20 nt, Artificial Sequence
  spacer sequence
gcgccucgcccacucuggcc

SEQ ID NO: 5755 - RNA, 20 nt, Artificial Sequence
  spacer sequence
ggccuauaaaguagucgcgg

SEQ ID NO: 5756 - RNA, 20 nt, Artificial Sequence
  spacer sequence
cggagacggggugcugguuu

SEQ ID NO: 5757 - RNA, 20 nt, Artificial Sequence
  spacer sequence
gcgacuacuuuauaggccag

SEQ ID NO: 5758 - RNA, 20 nt, Artificial Sequence
  spacer sequence
ccgcgacuacuuuauaggcc

SEQ ID NO: 5759 - RNA, 20 nt, Artificial Sequence
  spacer sequence
uagucuccugcagcgucugg

SEQ ID NO: 5760 - RNA, 20 nt, Artificial Sequence
  spacer sequence
ccugcagcgucugggguuuc

SEQ ID NO: 5761 - RNA, 20 nt, Artificial Sequence
  spacer sequence
ugcagcgucugggguuuccg

SEQ ID NO: 5762 - RNA, 20 nt, Artificial Sequence
  spacer sequence
gggguuuccguugcaguccu

SEQ ID NO: 5763 - RNA, 20 nt, Artificial Sequence
  spacer sequence
guugcaguccucggaaccag

SEQ ID NO: 5764 - RNA, 20 nt, Artificial Sequence
  spacer sequence
ucggaaccaggaccucggcg

SEQ ID NO: 5765 - RNA, 20 nt, Artificial Sequence
  spacer sequence
gaaccaggaccucggcgugg

SEQ ID NO: 5766 - RNA, 20 nt, Artificial Sequence
  spacer sequence
gaggacugcaacggaaaccc

SEQ ID NO: 5767 - RNA, 20 nt, Artificial Sequence
  spacer sequence
ugguuccgaggacugcaacg

SEQ ID NO: 5768 - RNA, 20 nt, Artificial Sequence
  spacer sequence
gcguggccuagcgaguuaug

SEQ ID NO: 5769 - RNA, 20 nt, Artificial Sequence
  spacer sequence
cuaggccacgccgagguccu

SEQ ID NO: 5770 - RNA, 20 nt, Artificial Sequence
  spacer sequence
ccauaacucgcuaggccacg

SEQ ID NO: 5771 - RNA, 20 nt, Artificial Sequence
  spacer sequence
ucgccauaacucgcuaggcc

SEQ ID NO: 5772 - RNA, 20 nt, Artificial Sequence
  spacer sequence
gcacgcacacggccuucguc

SEQ ID NO: 5773 - RNA, 20 nt, Artificial Sequence
  spacer sequence
cccuucagcacgcacacggc

SEQ ID NO: 5774 - RNA, 20 nt, Artificial Sequence
  spacer sequence
ucaauuucgagcagaaggca

SEQ ID NO: 5775 - RNA, 20 nt, Artificial Sequence
  spacer sequence
auuucgagcagaaggcaagg

SEQ ID NO: 5776 - RNA, 20 nt, Artificial Sequence
  spacer sequence
agcagaaggcaagggcuggg

SEQ ID NO: 5777 - RNA, 20 nt, Artificial Sequence
  spacer sequence
aaauugaugaugcccugcac

SEQ ID NO: 5778 - RNA, 20 nt, Artificial Sequence
  spacer sequence
gcucgaaauugaugaugccc

SEQ ID NO: 5779 - RNA, 20 nt, Artificial Sequence
  spacer sequence
cagcccuugccuucugcucg

SEQ ID NO: 5780 - RNA, 20 nt, Artificial Sequence
  spacer sequence
gucccagcccuugccuucug

SEQ ID NO: 5781 - RNA, 20 nt, Artificial Sequence
  spacer sequence
caaacaagccuccgucccag

SEQ ID NO: 5782 - RNA, 20 nt, Artificial Sequence
  spacer sequence
cacccgcucguccccccgcg

SEQ ID NO: 5783 - RNA, 20 nt, Artificial Sequence
  spacer sequence
uccccccgcgcaccuuugcu

SEQ ID NO: 5784 - RNA, 20 nt, Artificial Sequence
  spacer sequence
ccccgcgcaccuuugcuagg

SEQ ID NO: 5785 - RNA, 20 nt, Artificial Sequence
  spacer sequence
uagcaaaggugcgcgggggg

SEQ ID NO: 5786 - RNA, 20 nt, Artificial Sequence
  spacer sequence
cccgccaggccucggggccg

SEQ ID NO: 5787 - RNA, 20 nt, Artificial Sequence
  spacer sequence
gggccgcccugguccagcgc

SEQ ID NO: 5788 - RNA, 20 nt, Artificial Sequence
  spacer sequence
agcgcccggucccggcccgu

SEQ ID NO: 5789 - RNA, 20 nt, Artificial Sequence
  spacer sequence
cggcccgugccgcccggucg

SEQ ID NO: 5790 - RNA, 20 nt, Artificial Sequence
  spacer sequence
gugccuucgcccccagcggu

SEQ ID NO: 5791 - RNA, 20 nt, Artificial Sequence
  spacer sequence
cccccagcggugcggugccc

SEQ ID NO: 5792 - RNA, 20 nt, Artificial Sequence
  spacer sequence
gcacuugggcaccgcaccgc

SEQ ID NO: 5793 - RNA, 20 nt, Artificial Sequence
  spacer sequence
ccgggcgggcccgggcgcgg

SEQ ID NO: 5794 - RNA, 20 nt, Artificial Sequence
  spacer sequence
cacgccccgcgcccgggccc

SEQ ID NO: 5795 - RNA, 20 nt, Artificial Sequence
  spacer sequence
gucccacgccccgcgcccgg

SEQ ID NO: 5796 - RNA, 20 nt, Artificial Sequence
  spacer sequence
cgccacgcgcaggcccagcc

SEQ ID NO: 5797 - RNA, 20 nt, Artificial Sequence
  spacer sequence
ccgcgcucccgccacgcgca

SEQ ID NO: 5798 - RNA, 20 nt, Artificial Sequence
  spacer sequence
cuccccgcgcucccgccacg

SEQ ID NO: 5799 - RNA, 20 nt, Artificial Sequence
  spacer sequence
ccggcccgcggcaaucccuc

SEQ ID NO: 5800 - RNA, 20 nt, Artificial Sequence
  spacer sequence
gugguccuugggccgccgcc

SEQ ID NO: 5801 - RNA, 20 nt, Artificial Sequence
  spacer sequence
uugggccgccgccgcggguc

SEQ ID NO: 5802 - RNA, 20 nt, Artificial Sequence
  spacer sequence
gucguggugccuggagcggc

SEQ ID NO: 5803 - RNA, 20 nt, Artificial Sequence
  spacer sequence
uggugccuggagcggcugug

SEQ ID NO: 5804 - RNA, 20 nt, Artificial Sequence
  spacer sequence
aggcaccacgacagacccgc

SEQ ID NO: 5805 - RNA, 20 nt, Artificial Sequence
  spacer sequence
ucccuugcuuggccguguuc

SEQ ID NO: 5806 - RNA, 20 nt, Artificial Sequence
  spacer sequence
cuugcuuggccguguucucg

SEQ ID NO: 5807 - RNA, 20 nt, Artificial Sequence
  spacer sequence
cguuccugagggucccgcgg

SEQ ID NO: 5808 - RNA, 20 nt, Artificial Sequence
  spacer sequence
uuccugagggucccgcggac

SEQ ID NO: 5809 - RNA, 20 nt, Artificial Sequence
  spacer sequence
ugagggucccgcggacaccg

SEQ ID NO: 5810 - RNA, 20 nt, Artificial Sequence
  spacer sequence
ggaacgagaacacggccaag

SEQ ID NO: 5811 - RNA, 20 nt, Artificial Sequence
  spacer sequence
cgcggacaccgaguggcgca

SEQ ID NO: 5812 - RNA, 20 nt, Artificial Sequence
  spacer sequence
gcgggacccucaggaacgag

SEQ ID NO: 5813 - RNA, 20 nt, Artificial Sequence
  spacer sequence
guguccgcgggacccucagg

SEQ ID NO: 5814 - RNA, 20 nt, Artificial Sequence
  spacer sequence
ccgggcugggccuggcacug

SEQ ID NO: 5815 - RNA, 20 nt, Artificial Sequence
  spacer sequence
ccauccccgggcugggccug

SEQ ID NO: 5816 - RNA, 20 nt, Artificial Sequence
  spacer sequence
ucgcaucccucuccgcuuuc

SEQ ID NO: 5817 - RNA, 20 nt, Artificial Sequence
  spacer sequence
caucccucuccgcuuuccgg

SEQ ID NO: 5818 - RNA, 20 nt, Artificial Sequence
  spacer sequence
cucuccgcuuuccggcuuca

SEQ ID NO: 5819 - RNA, 20 nt, Artificial Sequence
  spacer sequence
ccgcuuuccggcuucagcgc

SEQ ID NO: 5820 - RNA, 20 nt, Artificial Sequence
  spacer sequence
gcuuuccggcuucagcgcuc

SEQ ID NO: 5821 - RNA, 20 nt, Artificial Sequence
  spacer sequence
ggcuucagcgcucuagguca

SEQ ID NO: 5822 - RNA, 20 nt, Artificial Sequence
  spacer sequence
gcgcucuaggucagggaguc

SEQ ID NO: 5823 - RNA, 20 nt, Artificial Sequence
  spacer sequence
aggucagggagucuucgcuu

SEQ ID NO: 5824 - RNA, 20 nt, Artificial Sequence
  spacer sequence
gggagucuucgcuuuuguac

SEQ ID NO: 5825 - RNA, 20 nt, Artificial Sequence
  spacer sequence
cugaccuagagcgcugaagc

SEQ ID NO: 5826 - RNA, 20 nt, Artificial Sequence
  spacer sequence
ucgcuuuuguacagcucuaa

SEQ ID NO: 5827 - RNA, 20 nt, Artificial Sequence
  spacer sequence
cuuuuguacagcucuaaggc

SEQ ID NO: 5828 - RNA, 20 nt, Artificial Sequence
  spacer sequence
aaggcuaggaaugguuuuua

SEQ ID NO: 5829 - RNA, 20 nt, Artificial Sequence
  spacer sequence
uagccuuagagcuguacaaa

SEQ ID NO: 5830 - RNA, 20 nt, Artificial Sequence
  spacer sequence
aaagccuuuuaaaaauauaa

SEQ ID NO: 5831 - RNA, 20 nt, Artificial Sequence
  spacer sequence
guugcguauuuuuguuuucc

SEQ ID NO: 5832 - RNA, 20 nt, Artificial Sequence
  spacer sequence
cuguugcguauuuuuguuuu

SEQ ID NO: 5833 - RNA, 20 nt, Artificial Sequence
  spacer sequence
cacaaacggucucuguugcg

SEQ ID NO: 5834 - RNA, 20 nt, Artificial Sequence
  spacer sequence
cugcaaagugucacacaaac

SEQ ID NO: 5835 - RNA, 20 nt, Artificial Sequence
  spacer sequence
guucuaggucaugauugggc

SEQ ID NO: 5836 - RNA, 20 nt, Artificial Sequence
  spacer sequence
aggucaugauugggcugcaa

SEQ ID NO: 5837 - RNA, 20 nt, Artificial Sequence
  spacer sequence
ugauugggcugcaagggcag

SEQ ID NO: 5838 - RNA, 20 nt, Artificial Sequence
  spacer sequence
ugaccuagaacagaggccag

SEQ ID NO: 5839 - RNA, 20 nt, Artificial Sequence
  spacer sequence
gcccuugcagcccaaucaug

SEQ ID NO: 5840 - RNA, 20 nt, Artificial Sequence
  spacer sequence
cugcccuugcagcccaauca

SEQ ID NO: 5841 - RNA, 20 nt, Artificial Sequence
  spacer sequence
aggcuaccuucucugcccuu

SEQ ID NO: 5842 - RNA, 20 nt, Artificial Sequence
  spacer sequence
guucaaggcuaccuucucug

SEQ ID NO: 5843 - RNA, 20 nt, Artificial Sequence
  spacer sequence
uuuuccuccuccuaagcucc

SEQ ID NO: 5844 - RNA, 20 nt, Artificial Sequence
  spacer sequence
uccuccuaagcuccgggagc

SEQ ID NO: 5845 - RNA, 20 nt, Artificial Sequence
  spacer sequence
uccuaagcuccgggagccag

SEQ ID NO: 5846 - RNA, 20 nt, Artificial Sequence
  spacer sequence
uaagcuccgggagccagagg

SEQ ID NO: 5847 - RNA, 20 nt, Artificial Sequence
  spacer sequence
gggagccagagguuuaacug

SEQ ID NO: 5848 - RNA, 20 nt, Artificial Sequence
  spacer sequence
cggagcuuaggaggaggaaa

SEQ ID NO: 5849 - RNA, 20 nt, Artificial Sequence
  spacer sequence
ggcucccggagcuuaggagg

SEQ ID NO: 5850 - RNA, 20 nt, Artificial Sequence
  spacer sequence
guuaaaccucuggcucccgg

SEQ ID NO: 5851 - RNA, 20 nt, Artificial Sequence
  spacer sequence
ccaaaagggucaguuaaacc

SEQ ID NO: 5852 - RNA, 20 nt, Artificial Sequence
  spacer sequence
aaaauccccaaaagggucag

SEQ ID NO: 5853 - RNA, 20 nt, Artificial Sequence
  spacer sequence
cugcccucaaaaauccccaa

SEQ ID NO: 5854 - RNA, 20 nt, Artificial Sequence
  spacer sequence
uaacuuugggugcacaguua

SEQ ID NO: 5855 - RNA, 20 nt, Artificial Sequence
  spacer sequence
aauaagcuaacugugcaccc

SEQ ID NO: 5856 - RNA, 20 nt, Artificial Sequence
  spacer sequence
ucaaauaagcuaacugugca

SEQ ID NO: 5857 - RNA, 20 nt, Artificial Sequence
  spacer sequence
uacuaaaaauacaccagagc

SEQ ID NO: 5858 - RNA, 20 nt, Artificial Sequence
  spacer sequence
gguguauuuuuaguaagauc

SEQ ID NO: 5859 - RNA, 20 nt, Artificial Sequence
  spacer sequence
gaccaauuacaucaaaaccu

SEQ ID NO: 5860 - RNA, 20 nt, Artificial Sequence
  spacer sequence
gagguugggcucugguguau

SEQ ID NO: 5861 - RNA, 20 nt, Artificial Sequence
  spacer sequence
aaaccuguccuagugcaggg

SEQ ID NO: 5862 - RNA, 20 nt, Artificial Sequence
  spacer sequence
uagugcagggugaguauugc

SEQ ID NO: 5863 - RNA, 20 nt, Artificial Sequence
  spacer sequence
cccugcacuaggacagguuu

SEQ ID NO: 5864 - RNA, 20 nt, Artificial Sequence
  spacer sequence
aaaaacagcaauacucaccc

SEQ ID NO: 5865 - RNA, 20 nt, Artificial Sequence
  spacer sequence
aaaagugauuuugaugugca

SEQ ID NO: 5866 - RNA, 20 nt, Artificial Sequence
  spacer sequence
cuuuuggaaacuuucaaaaa

SEQ ID NO: 5867 - RNA, 20 nt, Artificial Sequence
  spacer sequence
aaaucacuuuuggaaacuuu

SEQ ID NO: 5868 - RNA, 20 nt, Artificial Sequence
  spacer sequence
uaggugcacaucaaaaucac

SEQ ID NO: 5869 - RNA, 20 nt, Artificial Sequence
  spacer sequence
aucguaggugcacaucaaaa

SEQ ID NO: 5870 - RNA, 20 nt, Artificial Sequence
  spacer sequence
caaucguaggugcacaucaa

SEQ ID NO: 5871 - RNA, 20 nt, Artificial Sequence
  spacer sequence
uuugaggacaguggguggag

SEQ ID NO: 5872 - RNA, 20 nt, Artificial Sequence
  spacer sequence
aacgacaguucucaaucgua

SEQ ID NO: 5873 - RNA, 20 nt, Artificial Sequence
  spacer sequence
ucaaacgacaguucucaauc

SEQ ID NO: 5874 - RNA, 20 nt, Artificial Sequence
  spacer sequence
acccacuguccucaaacgac

SEQ ID NO: 5875 - RNA, 20 nt, Artificial Sequence
  spacer sequence
uauuuggaaauuagaagacc

SEQ ID NO: 5876 - RNA, 20 nt, Artificial Sequence
  spacer sequence
aaauacgaaacuccacccac

SEQ ID NO: 5877 - RNA, 20 nt, Artificial Sequence
  spacer sequence
aauuuccaaauacgaaacuc

SEQ ID NO: 5878 - RNA, 20 nt, Artificial Sequence
  spacer sequence
ucuaauuuccaaauacgaaa

SEQ ID NO: 5879 - RNA, 20 nt, Artificial Sequence
  spacer sequence
aggucuucuaauuuccaaau

SEQ ID NO: 5880 - RNA, 20 nt, Artificial Sequence
  spacer sequence
auuacaccgaauuggcacuu

SEQ ID NO: 5881 - RNA, 20 nt, Artificial Sequence
  spacer sequence
guguaauggaaacuccaggu

SEQ ID NO: 5882 - RNA, 20 nt, Artificial Sequence
  spacer sequence
gagcauuucuuaagccacau

SEQ ID NO: 5883 - RNA, 20 nt, Artificial Sequence
  spacer sequence
gacaacaguuauuaagugcc

SEQ ID NO: 5884 - RNA, 20 nt, Artificial Sequence
  spacer sequence
uaagccacauuuucguaaag

SEQ ID NO: 5885 - RNA, 20 nt, Artificial Sequence
  spacer sequence
uaaaguggcuuuaaaauugc

SEQ ID NO: 5886 - RNA, 20 nt, Artificial Sequence
  spacer sequence
gccaguaggcagguugcuaa

SEQ ID NO: 5887 - RNA, 20 nt, Artificial Sequence
  spacer sequence
uagcaaccugccuacuggca

SEQ ID NO: 5888 - RNA, 20 nt, Artificial Sequence
  spacer sequence
gagacaaacuucugaacgac

SEQ ID NO: 5889 - RNA, 20 nt, Artificial Sequence
  spacer sequence
gaccaucuuagcaaccugcc

SEQ ID NO: 5890 - RNA, 20 nt, Artificial Sequence
  spacer sequence
cugaccaucuuagcaaccug

SEQ ID NO: 5891 - RNA, 20 nt, Artificial Sequence
  spacer sequence
gaacgacucuuguaaaauau

SEQ ID NO: 5892 - RNA, 20 nt, Artificial Sequence
  spacer sequence
gaaguuugucucugaccauc

SEQ ID NO: 5893 - RNA, 20 nt, Artificial Sequence
  spacer sequence
uucagaaguuugucucugac

SEQ ID NO: 5894 - RNA, 20 nt, Artificial Sequence
  spacer sequence
uguaaaauauacagaaauau

SEQ ID NO: 5895 - RNA, 20 nt, Artificial Sequence
  spacer sequence
guauauuuuacaagagucgu

SEQ ID NO: 5896 - RNA, 20 nt, Artificial Sequence
  spacer sequence
gaacuuuuaucaguaaaauu

SEQ ID NO: 5897 - RNA, 20 nt, Artificial Sequence
  spacer sequence
gaaaauauuucuguauauuu

SEQ ID NO: 5898 - RNA, 20 nt, Artificial Sequence
  spacer sequence
guaaaauuacaaaacguguu

SEQ ID NO: 5899 - RNA, 20 nt, Artificial Sequence
  spacer sequence
uugcaacacguuuuguaauu

SEQ ID NO: 5900 - RNA, 20 nt, Artificial Sequence
  spacer sequence
caagcaccuuccuugcaaca

SEQ ID NO: 5901 - RNA, 20 nt, Artificial Sequence
  spacer sequence
ccagaaccuuagugaaguua

SEQ ID NO: 5902 - RNA, 20 nt, Artificial Sequence
  spacer sequence
ggggacaguguuaucacaag

SEQ ID NO: 5903 - RNA, 20 nt, Artificial Sequence
  spacer sequence
cuaagguucuggggacagug

SEQ ID NO: 5904 - RNA, 20 nt, Artificial Sequence
  spacer sequence
accaguugguaacuucacua

SEQ ID NO: 5905 - RNA, 20 nt, Artificial Sequence
  spacer sequence
cuugcacucggcuuaaaaau

SEQ ID NO: 5906 - RNA, 20 nt, Artificial Sequence
  spacer sequence
ugcacucggcuuaaaaauca

SEQ ID NO: 5907 - RNA, 20 nt, Artificial Sequence
  spacer sequence
gcuuaaaaaucaugagggaa

SEQ ID NO: 5908 - RNA, 20 nt, Artificial Sequence
  spacer sequence
ugagggaauauuuacuauac

SEQ ID NO: 5909 - RNA, 20 nt, Artificial Sequence
  spacer sequence
ugauuuuuaagccgagugca

SEQ ID NO: 5910 - RNA, 20 nt, Artificial Sequence
  spacer sequence
cucaugauuuuuaagccgag

SEQ ID NO: 5911 - RNA, 20 nt, Artificial Sequence
  spacer sequence
uauaguaaauauucccucau

SEQ ID NO: 5912 - RNA, 20 nt, Artificial Sequence
  spacer sequence
uucguauaguaaauauuccc

SEQ ID NO: 5913 - RNA, 20 nt, Artificial Sequence
  spacer sequence
cauucguauaguaaauauuc

SEQ ID NO: 5914 - RNA, 20 nt, Artificial Sequence
  spacer sequence
gucuuuaaagggguuuacag

SEQ ID NO: 5915 - RNA, 20 nt, Artificial Sequence
  spacer sequence
uuaaagggguuuacagaaac

SEQ ID NO: 5916 - RNA, 20 nt, Artificial Sequence
  spacer sequence
guaaaccccuuuaaagacug

SEQ ID NO: 5917 - RNA, 20 nt, Artificial Sequence
  spacer sequence
cguuucuguaaaccccuuua

SEQ ID NO: 5918 - RNA, 20 nt, Artificial Sequence
  spacer sequence
cacguuucuguaaaccccuu

SEQ ID NO: 5919 - RNA, 20 nt, Artificial Sequence
  spacer sequence
ucucacguuucuguaaaccc

SEQ ID NO: 5920 - RNA, 20 nt, Artificial Sequence
  spacer sequence
uguccucucacguuucugua

SEQ ID NO: 5921 - RNA, 20 nt, Artificial Sequence
  spacer sequence
guguaaaugucugaaauaua

SEQ ID NO: 5922 - RNA, 20 nt, Artificial Sequence
  spacer sequence
gaaauauaugugagggagau

SEQ ID NO: 5923 - RNA, 20 nt, Artificial Sequence
  spacer sequence
gacauuuacacagacuaacu

SEQ ID NO: 5924 - RNA, 20 nt, Artificial Sequence
  spacer sequence
cauauauuucagacauuuac

SEQ ID NO: 5925 - RNA, 20 nt, Artificial Sequence
  spacer sequence
cucacauauauuucagacau

SEQ ID NO: 5926 - RNA, 20 nt, Artificial Sequence
  spacer sequence
cccucacauauauuucagac

SEQ ID NO: 5927 - RNA, 20 nt, Artificial Sequence
  spacer sequence
uuaucucccucacauauauu

SEQ ID NO: 5928 - RNA, 20 nt, Artificial Sequence
  spacer sequence
uuaauaggucuccagauuuu

SEQ ID NO: 5929 - RNA, 20 nt, Artificial Sequence
  spacer sequence
ccagauuuucuggaaaaggu

SEQ ID NO: 5930 - RNA, 20 nt, Artificial Sequence
  spacer sequence
agauuuucuggaaaagguuc

SEQ ID NO: 5931 - RNA, 20 nt, Artificial Sequence
  spacer sequence
ggagaccuauuaaagaaaaa

SEQ ID NO: 5932 - RNA, 20 nt, Artificial Sequence
  spacer sequence
ggaaaagguucuuuggcauu

SEQ ID NO: 5933 - RNA, 20 nt, Artificial Sequence
  spacer sequence
agaaaaucuggagaccuauu

SEQ ID NO: 5934 - RNA, 20 nt, Artificial Sequence
  spacer sequence
uuggcauuugacuccauuuu

SEQ ID NO: 5935 - RNA, 20 nt, Artificial Sequence
  spacer sequence
aaugccaaagaaccuuuucc

SEQ ID NO: 5936 - RNA, 20 nt, Artificial Sequence
  spacer sequence
auuuugcuguuucauuuguc

SEQ ID NO: 5937 - RNA, 20 nt, Artificial Sequence
  spacer sequence
uuugucagacuucuuuuugu

SEQ ID NO: 5938 - RNA, 20 nt, Artificial Sequence
  spacer sequence
gacuucuuuuugucccucuu

SEQ ID NO: 5939 - RNA, 20 nt, Artificial Sequence
  spacer sequence
gacaaaugaaacagcaaaau

SEQ ID NO: 5940 - RNA, 20 nt, Artificial Sequence
  spacer sequence
uuuugucccucuuuacuucu

SEQ ID NO: 5941 - RNA, 20 nt, Artificial Sequence
  spacer sequence
cucuuuacuucuccccacau

SEQ ID NO: 5942 - RNA, 20 nt, Artificial Sequence
  spacer sequence
uuacuucuccccacauaauu

SEQ ID NO: 5943 - RNA, 20 nt, Artificial Sequence
  spacer sequence
ccccacauaauucaccagua

SEQ ID NO: 5944 - RNA, 20 nt, Artificial Sequence
  spacer sequence
ccacauaauucaccaguacu

SEQ ID NO: 5945 - RNA, 20 nt, Artificial Sequence
  spacer sequence
ccaguacuaguguuuuguuu

SEQ ID NO: 5946 - RNA, 20 nt, Artificial Sequence
  spacer sequence
gaccaagucucgcucugucg

SEQ ID NO: 5947 - RNA, 20 nt, Artificial Sequence
  spacer sequence
gaaaaacaaaacacuaguac

SEQ ID NO: 5948 - RNA, 20 nt, Artificial Sequence
  spacer sequence
cgcucugucgcccaggcugg

SEQ ID NO: 5949 - RNA, 20 nt, Artificial Sequence
  spacer sequence
cucugucgcccaggcuggag

SEQ ID NO: 5950 - RNA, 20 nt, Artificial Sequence
  spacer sequence
gucgcccaggcuggagugca

SEQ ID NO: 5951 - RNA, 20 nt, Artificial Sequence
  spacer sequence
cccaggcuggagugcagugg

SEQ ID NO: 5952 - RNA, 20 nt, Artificial Sequence
  spacer sequence
agccugggcgacagagcgag

SEQ ID NO: 5953 - RNA, 20 nt, Artificial Sequence
  spacer sequence
cgccacugcacuccagccug

SEQ ID NO: 5954 - RNA, 20 nt, Artificial Sequence
  spacer sequence
cagcucacugcaaccuccgc

SEQ ID NO: 5955 - RNA, 20 nt, Artificial Sequence
  spacer sequence
gcucacugcaaccuccgccu

SEQ ID NO: 5956 - RNA, 20 nt, Artificial Sequence
  spacer sequence
cugcaaccuccgccucccag

SEQ ID NO: 5957 - RNA, 20 nt, Artificial Sequence
  spacer sequence
gccucccagguucaagcaau

SEQ ID NO: 5958 - RNA, 20 nt, Artificial Sequence
  spacer sequence
cagguucaagcaauucuccu

SEQ ID NO: 5959 - RNA, 20 nt, Artificial Sequence
  spacer sequence
agcaauucuccugccucagc

SEQ ID NO: 5960 - RNA, 20 nt, Artificial Sequence
  spacer sequence
ccugccucagccucccgggu

SEQ ID NO: 5961 - RNA, 20 nt, Artificial Sequence
  spacer sequence
ugccucagccucccggguag

SEQ ID NO: 5962 - RNA, 20 nt, Artificial Sequence
  spacer sequence
gccucccggguagcugggac

SEQ ID NO: 5963 - RNA, 20 nt, Artificial Sequence
  spacer sequence
cggguagcugggacuacagg

SEQ ID NO: 5964 - RNA, 20 nt, Artificial Sequence
  spacer sequence
cagcuacccgggaggcugag

SEQ ID NO: 5965 - RNA, 20 nt, Artificial Sequence
  spacer sequence
acuaaaauauaaaaaauuag

SEQ ID NO: 5966 - RNA, 20 nt, Artificial Sequence
  spacer sequence
cuacuaaaauauaaaaaauu

SEQ ID NO: 5967 - RNA, 20 nt, Artificial Sequence
  spacer sequence
ccauguuggccaggaugguc

SEQ ID NO: 5968 - RNA, 20 nt, Artificial Sequence
  spacer sequence
uggccaacauggugaaacgc

SEQ ID NO: 5969 - RNA, 20 nt, Artificial Sequence
  spacer sequence
cgaucuguugacgucgugau

SEQ ID NO: 5970 - RNA, 20 nt, Artificial Sequence
  spacer sequence
aucuguugacgucgugaucc

SEQ ID NO: 5971 - RNA, 20 nt, Artificial Sequence
  spacer sequence
agaccauccuggccaacaug

SEQ ID NO: 5972 - RNA, 20 nt, Artificial Sequence
  spacer sequence
guugacgucgugauccaccc

SEQ ID NO: 5973 - RNA, 20 nt, Artificial Sequence
  spacer sequence
acagaucgagaccauccugg

SEQ ID NO: 5974 - RNA, 20 nt, Artificial Sequence
  spacer sequence
ugauccacccgccucggccu

SEQ ID NO: 5975 - RNA, 20 nt, Artificial Sequence
  spacer sequence
cgacgucaacagaucgagac

SEQ ID NO: 5976 - RNA, 20 nt, Artificial Sequence
  spacer sequence
acccgccucggccucccaaa

SEQ ID NO: 5977 - RNA, 20 nt, Artificial Sequence
  spacer sequence
gccucccaaagugcugggau

SEQ ID NO: 5978 - RNA, 20 nt, Artificial Sequence
  spacer sequence
caaagugcugggauuacagg

SEQ ID NO: 5979 - RNA, 20 nt, Artificial Sequence
  spacer sequence
cagcacuuugggaggccgag

SEQ ID NO: 5980 - RNA, 20 nt, Artificial Sequence
  spacer sequence
cgccuguaaucccagcacuu

SEQ ID NO: 5981 - RNA, 20 nt, Artificial Sequence
  spacer sequence
uaagacgccucugaggaauc

SEQ ID NO: 5982 - RNA, 20 nt, Artificial Sequence
  spacer sequence
uaagaauagcacugguggcc

SEQ ID NO: 5983 - RNA, 20 nt, Artificial Sequence
  spacer sequence
gaggaaucccuucucccugg

SEQ ID NO: 5984 - RNA, 20 nt, Artificial Sequence
  spacer sequence
gaggcgucuuaagaauagca

SEQ ID NO: 5985 - RNA, 20 nt, Artificial Sequence
  spacer sequence
ucagaggcgucuuaagaaua

SEQ ID NO: 5986 - RNA, 20 nt, Artificial Sequence
  spacer sequence
cuucucccuggccauugaga

SEQ ID NO: 5987 - RNA, 20 nt, Artificial Sequence
  spacer sequence
cccuggccauugagaaucca

SEQ ID NO: 5988 - RNA, 20 nt, Artificial Sequence
  spacer sequence
cuggccauugagaauccaug

SEQ ID NO: 5989 - RNA, 20 nt, Artificial Sequence
  spacer sequence
auggccagggagaagggauu

SEQ ID NO: 5990 - RNA, 20 nt, Artificial Sequence
  spacer sequence
caauggccagggagaaggga

SEQ ID NO: 5991 - RNA, 20 nt, Artificial Sequence
  spacer sequence
augcaugaacccagguuuuc

SEQ ID NO: 5992 - RNA, 20 nt, Artificial Sequence
  spacer sequence
ugcauggauucucaauggcc

SEQ ID NO: 5993 - RNA, 20 nt, Artificial Sequence
  spacer sequence
accuucccugagcagcuugc

SEQ ID NO: 5994 - RNA, 20 nt, Artificial Sequence
  spacer sequence
cugagcagcuugcauaguuc

SEQ ID NO: 5995 - RNA, 20 nt, Artificial Sequence
  spacer sequence
gggaagguggaaaaccuggg

SEQ ID NO: 5996 - RNA, 20 nt, Artificial Sequence
  spacer sequence
uucuuuuaagcgccugacuu

SEQ ID NO: 5997 - RNA, 20 nt, Artificial Sequence
  spacer sequence
uuuaagcgccugacuucguu

SEQ ID NO: 5998 - RNA, 20 nt, Artificial Sequence
  spacer sequence
ggcgcuuaaaagaaggaacu

SEQ ID NO: 5999 - RNA, 20 nt, Artificial Sequence
  spacer sequence
uuuuguuuggugcccguugu

SEQ ID NO: 6000 - RNA, 20 nt, Artificial Sequence
  spacer sequence
gguacaacgggcaccaaaca

SEQ ID NO: 6001 - RNA, 20 nt, Artificial Sequence
  spacer sequence
cagguacaacgggcaccaaa

SEQ ID NO: 6002 - RNA, 20 nt, Artificial Sequence
  spacer sequence
uucucagguacaacgggcac

SEQ ID NO: 6003 - RNA, 20 nt, Artificial Sequence
  spacer sequence
aaggcucauucucagguaca

SEQ ID NO: 6004 - RNA, 20 nt, Artificial Sequence
  spacer sequence
acuauccaaggcucauucuc

SEQ ID NO: 6005 - RNA, 20 nt, Artificial Sequence
  spacer sequence
agcuuuccagauaugcagag

SEQ ID NO: 6006 - RNA, 20 nt, Artificial Sequence
  spacer sequence
agauaugcagagauaauaca

SEQ ID NO: 6007 - RNA, 20 nt, Artificial Sequence
  spacer sequence
ggaaagcuggaaugcuccac

SEQ ID NO: 6008 - RNA, 20 nt, Artificial Sequence
  spacer sequence
gcauaucuggaaagcuggaa

SEQ ID NO: 6009 - RNA, 20 nt, Artificial Sequence
  spacer sequence
cugcauaucuggaaagcugg

SEQ ID NO: 6010 - RNA, 20 nt, Artificial Sequence
  spacer sequence
gcuacuuggcuuggccuauu

SEQ ID NO: 6011 - RNA, 20 nt, Artificial Sequence
  spacer sequence
guguuuaaaaucuuggacuc

SEQ ID NO: 6012 - RNA, 20 nt, Artificial Sequence
  spacer sequence
uggacucuuugcuaguuuuu

SEQ ID NO: 6013 - RNA, 20 nt, Artificial Sequence
  spacer sequence
aagauuuuaaacacggaaua

SEQ ID NO: 6014 - RNA, 20 nt, Artificial Sequence
  spacer sequence
uugcuaguuuuuacagauca

SEQ ID NO: 6015 - RNA, 20 nt, Artificial Sequence
  spacer sequence
guaaaaacuagcaaagaguc

SEQ ID NO: 6016 - RNA, 20 nt, Artificial Sequence
  spacer sequence
gaauuuuucacguauuaauc

SEQ ID NO: 6017 - RNA, 20 nt, Artificial Sequence
  spacer sequence
gaucuguaaaaacuagcaaa

SEQ ID NO: 6018 - RNA, 20 nt, Artificial Sequence
  spacer sequence
cguauuaauccaguuuuccu

SEQ ID NO: 6019 - RNA, 20 nt, Artificial Sequence
  spacer sequence
aguuuuccuagcuucucuug

SEQ ID NO: 6020 - RNA, 20 nt, Artificial Sequence
  spacer sequence
uagcuucucuugaagaauuu

SEQ ID NO: 6021 - RNA, 20 nt, Artificial Sequence
  spacer sequence
cuugaagaauuuuuggagau

SEQ ID NO: 6022 - RNA, 20 nt, Artificial Sequence
  spacer sequence
ugaagaauuuuuggagaucu

SEQ ID NO: 6023 - RNA, 20 nt, Artificial Sequence
  spacer sequence
agagaagcuaggaaaacugg

SEQ ID NO: 6024 - RNA, 20 nt, Artificial Sequence
  spacer sequence
ucaagagaagcuaggaaaac

SEQ ID NO: 6025 - RNA, 20 nt, Artificial Sequence
  spacer sequence
aaaaauucuucaagagaagc

SEQ ID NO: 6026 - RNA, 20 nt, Artificial Sequence
  spacer sequence
ccaaaaauucuucaagagaa

SEQ ID NO: 6027 - RNA, 20 nt, Artificial Sequence
  spacer sequence
cuucauacugagccuucauu

SEQ ID NO: 6028 - RNA, 20 nt, Artificial Sequence
  spacer sequence
ucauacugagccuucauuag

SEQ ID NO: 6029 - RNA, 20 nt, Artificial Sequence
  spacer sequence
uacugagccuucauuagccc

SEQ ID NO: 6030 - RNA, 20 nt, Artificial Sequence
  spacer sequence
guaugaagagaucuccaaaa

SEQ ID NO: 6031 - RNA, 20 nt, Artificial Sequence
  spacer sequence
uuagcccaggacaguacugc

SEQ ID NO: 6032 - RNA, 20 nt, Artificial Sequence
  spacer sequence
ugggcuaaugaaggcucagu

SEQ ID NO: 6033 - RNA, 20 nt, Artificial Sequence
  spacer sequence
uauauuuuuucgcuucccag

SEQ ID NO: 6034 - RNA, 20 nt, Artificial Sequence
  spacer sequence
cuucccaggccuguguuauu

SEQ ID NO: 6035 - RNA, 20 nt, Artificial Sequence
  spacer sequence
caggccuguguuauucacuu

SEQ ID NO: 6036 - RNA, 20 nt, Artificial Sequence
  spacer sequence
cuuaaguucauagccugguc

SEQ ID NO: 6037 - RNA, 20 nt, Artificial Sequence
  spacer sequence
uagccuggucccugcagggu

SEQ ID NO: 6038 - RNA, 20 nt, Artificial Sequence
  spacer sequence
cugcaggguuguacccgagc

SEQ ID NO: 6039 - RNA, 20 nt, Artificial Sequence
  spacer sequence
gguacaacccugcagggacc

SEQ ID NO: 6040 - RNA, 20 nt, Artificial Sequence
  spacer sequence
aaguagcugugcucggguac

SEQ ID NO: 6041 - RNA, 20 nt, Artificial Sequence
  spacer sequence
ugaauguauuaccgguuaaa

SEQ ID NO: 6042 - RNA, 20 nt, Artificial Sequence
  spacer sequence
ggacaucuaaguagcugugc

SEQ ID NO: 6043 - RNA, 20 nt, Artificial Sequence
  spacer sequence
auuuaaccgguaauacauuc

SEQ ID NO: 6044 - RNA, 20 nt, Artificial Sequence
  spacer sequence
aagaaccugcuguuuuuggc

SEQ ID NO: 6045 - RNA, 20 nt, Artificial Sequence
  spacer sequence
uugaaaccuccauuuaaccg

SEQ ID NO: 6046 - RNA, 20 nt, Artificial Sequence
  spacer sequence
ugauaacagaguguuugagg

SEQ ID NO: 6047 - RNA, 20 nt, Artificial Sequence
  spacer sequence
agagcacagggccaaaaaca

SEQ ID NO: 6048 - RNA, 20 nt, Artificial Sequence
  spacer sequence
guuaucaagagcacagggcc

SEQ ID NO: 6049 - RNA, 20 nt, Artificial Sequence
  spacer sequence
aacacucuguuaucaagagc

SEQ ID NO: 6050 - RNA, 20 nt, Artificial Sequence
  spacer sequence
cucaaacacucuguuaucaa

SEQ ID NO: 6051 - RNA, 20 nt, Artificial Sequence
  spacer sequence
cauuugaguuuuuccaaaau

SEQ ID NO: 6052 - RNA, 20 nt, Artificial Sequence
  spacer sequence
aaugugaaaguugucccuca

SEQ ID NO: 6053 - RNA, 20 nt, Artificial Sequence
  spacer sequence
aaaauuaaagguuguagaag

SEQ ID NO: 6054 - RNA, 20 nt, Artificial Sequence
  spacer sequence
acaaccuuuaauuuuggaaa

SEQ ID NO: 6055 - RNA, 20 nt, Artificial Sequence
  spacer sequence
ucuacaaccuuuaauuuugg

SEQ ID NO: 6056 - RNA, 20 nt, Artificial Sequence
  spacer sequence
caguaucuauugucaaaaag

SEQ ID NO: 6057 - RNA, 20 nt, Artificial Sequence
  spacer sequence
auugucaaaaagaaaagaau

SEQ ID NO: 6058 - RNA, 20 nt, Artificial Sequence
  spacer sequence
aaaagaaaagaauuuaaaaa

SEQ ID NO: 6059 - RNA, 20 nt, Artificial Sequence
  spacer sequence
uuuugacaauagauacugug

SEQ ID NO: 6060 - RNA, 20 nt, Artificial Sequence
  spacer sequence
uuucuuuuugacaauagaua

SEQ ID NO: 6061 - RNA, 20 nt, Artificial Sequence
  spacer sequence
uggcaauugcugccuuuuua

SEQ ID NO: 6062 - RNA, 20 nt, Artificial Sequence
  spacer sequence
uuugagcaaugauauuuucc

SEQ ID NO: 6063 - RNA, 20 nt, Artificial Sequence
  spacer sequence
aaugaaguauccuggcaauu

SEQ ID NO: 6064 - RNA, 20 nt, Artificial Sequence
  spacer sequence
uugcucaaaugaaguauccu

SEQ ID NO: 6065 - RNA, 20 nt, Artificial Sequence
  spacer sequence
aguggaaagucacaucuuaa

SEQ ID NO: 6066 - RNA, 20 nt, Artificial Sequence
  spacer sequence
acuggaaaauaucauugcuc

SEQ ID NO: 6067 - RNA, 20 nt, Artificial Sequence
  spacer sequence
caucuuaaggguuaaugccc

SEQ ID NO: 6068 - RNA, 20 nt, Artificial Sequence
  spacer sequence
uaaggguuaaugccccuuaa

SEQ ID NO: 6069 - RNA, 20 nt, Artificial Sequence
  spacer sequence
aauacggccaacaguuaagg

SEQ ID NO: 6070 - RNA, 20 nt, Artificial Sequence
  spacer sequence
uguuuuuagcuugguuuguu

SEQ ID NO: 6071 - RNA, 20 nt, Artificial Sequence
  spacer sequence
cuuguuuuuagcuugguuug

SEQ ID NO: 6072 - RNA, 20 nt, Artificial Sequence
  spacer sequence
gugucucuuguuuuuagcuu

SEQ ID NO: 6073 - RNA, 20 nt, Artificial Sequence
  spacer sequence
uacaacaugucagugucucu

SEQ ID NO: 6074 - RNA, 20 nt, Artificial Sequence
  spacer sequence
acaccacaccgucauacaac

SEQ ID NO: 6075 - RNA, 20 nt, Artificial Sequence
  spacer sequence
ugagaucuaguuguaacuuc

SEQ ID NO: 6076 - RNA, 20 nt, Artificial Sequence
  spacer sequence
ggacuaaaauaaacacaaca

SEQ ID NO: 6077 - RNA, 20 nt, Artificial Sequence
  spacer sequence
caggacuaaaauaaacacaa

SEQ ID NO: 6078 - RNA, 20 nt, Artificial Sequence
  spacer sequence
aguuguaacuuccuugauuu

SEQ ID NO: 6079 - RNA, 20 nt, Artificial Sequence
  spacer sequence
uugauuucuguauguagcca

SEQ ID NO: 6080 - RNA, 20 nt, Artificial Sequence
  spacer sequence
aggaaguuacaacuagaucu

SEQ ID NO: 6081 - RNA, 20 nt, Artificial Sequence
  spacer sequence
guauguagccacggagcacc

SEQ ID NO: 6082 - RNA, 20 nt, Artificial Sequence
  spacer sequence
guggcuacauacagaaauca

SEQ ID NO: 6083 - RNA, 20 nt, Artificial Sequence
  spacer sequence
ccauuaccugaauggcuaua

SEQ ID NO: 6084 - RNA, 20 nt, Artificial Sequence
  spacer sequence
gguaauggugacagguaaug

SEQ ID NO: 6085 - RNA, 20 nt, Artificial Sequence
  spacer sequence
uuuugguagaguggaaaggu

SEQ ID NO: 6086 - RNA, 20 nt, Artificial Sequence
  spacer sequence
accaaaaugaaagcaagcag

SEQ ID NO: 6087 - RNA, 20 nt, Artificial Sequence
  spacer sequence
acucuaccaaaaugaaagca

SEQ ID NO: 6088 - RNA, 20 nt, Artificial Sequence
  spacer sequence
gugcuugaaaagauuucaga

SEQ ID NO: 6089 - RNA, 20 nt, Artificial Sequence
  spacer sequence
agcacugaaaccuagguaac

SEQ ID NO: 6090 - RNA, 20 nt, Artificial Sequence
  spacer sequence
uuucaagcacugaaaccuag

SEQ ID NO: 6091 - RNA, 20 nt, Artificial Sequence
  spacer sequence
gaaagcaguaguacgucugg

SEQ ID NO: 6092 - RNA, 20 nt, Artificial Sequence
  spacer sequence
gaaaucuuuucaagcacuga

SEQ ID NO: 6093 - RNA, 20 nt, Artificial Sequence
  spacer sequence
gguuagacuagaaucagucc

SEQ ID NO: 6094 - RNA, 20 nt, Artificial Sequence
  spacer sequence
aaccagacguacuacugcuu

SEQ ID NO: 6095 - RNA, 20 nt, Artificial Sequence
  spacer sequence
agucuaaccagacguacuac

SEQ ID NO: 6096 - RNA, 20 nt, Artificial Sequence
  spacer sequence
guccucuccugggggcagug

SEQ ID NO: 6097 - RNA, 20 nt, Artificial Sequence
  spacer sequence
ucuccugggggcaguggaau

SEQ ID NO: 6098 - RNA, 20 nt, Artificial Sequence
  spacer sequence
ccugggggcaguggaauaua

SEQ ID NO: 6099 - RNA, 20 nt, Artificial Sequence
  spacer sequence
ugggggcaguggaauauaau

SEQ ID NO: 6100 - RNA, 20 nt, Artificial Sequence
  spacer sequence
acugcccccaggagaggacu

SEQ ID NO: 6101 - RNA, 20 nt, Artificial Sequence
  spacer sequence
gacugcuaauuaaaaauacc

SEQ ID NO: 6102 - RNA, 20 nt, Artificial Sequence
  spacer sequence
gaaaauauuauauuccacug

SEQ ID NO: 6103 - RNA, 20 nt, Artificial Sequence
  spacer sequence
cagguauuuuuaauuagcag

SEQ ID NO: 6104 - RNA, 20 nt, Artificial Sequence
  spacer sequence
cagcacuuugggaggccgag

SEQ ID NO: 6105 - RNA, 20 nt, Artificial Sequence
  spacer sequence
caaagugcugggauuacagg

SEQ ID NO: 6106 - RNA, 20 nt, Artificial Sequence
  spacer sequence
gccucccaaagugcugggau

SEQ ID NO: 6107 - RNA, 20 nt, Artificial Sequence
  spacer sequence
cggccucccaaagugcuggg

SEQ ID NO: 6108 - RNA, 20 nt, Artificial Sequence
  spacer sequence
acccgucucggccucccaaa

SEQ ID NO: 6109 - RNA, 20 nt, Artificial Sequence
  spacer sequence
cgaggucagcagauggagac

SEQ ID NO: 6110 - RNA, 20 nt, Artificial Sequence
  spacer sequence
ugauccacccgucucggccu

SEQ ID NO: 6111 - RNA, 20 nt, Artificial Sequence
  spacer sequence
gcagauggagaccauccugg

SEQ ID NO: 6112 - RNA, 20 nt, Artificial Sequence
  spacer sequence
gcugaccucgugauccaccc

SEQ ID NO: 6113 - RNA, 20 nt, Artificial Sequence
  spacer sequence
aucugcugaccucgugaucc

SEQ ID NO: 6114 - RNA, 20 nt, Artificial Sequence
  spacer sequence
ccaucugcugaccucgugau

SEQ ID NO: 6115 - RNA, 20 nt, Artificial Sequence
  spacer sequence
uggcuaacacggugaaaccc

SEQ ID NO: 6116 - RNA, 20 nt, Artificial Sequence
  spacer sequence
ccguguuagccaggaugguc

SEQ ID NO: 6117 - RNA, 20 nt, Artificial Sequence
  spacer sequence
cuacuaaaaaugcaaaaaaa

SEQ ID NO: 6118 - RNA, 20 nt, Artificial Sequence
  spacer sequence
acuaaaaaugcaaaaaaauu

SEQ ID NO: 6119 - RNA, 20 nt, Artificial Sequence
  spacer sequence
cagcuacucaggaggcugag

SEQ ID NO: 6120 - RNA, 20 nt, Artificial Sequence
  spacer sequence
ggaggcugaggcaggagaau

SEQ ID NO: 6121 - RNA, 20 nt, Artificial Sequence
  spacer sequence
ugaguagcugggacuacagg

SEQ ID NO: 6122 - RNA, 20 nt, Artificial Sequence
  spacer sequence
gccuccugaguagcugggac

SEQ ID NO: 6123 - RNA, 20 nt, Artificial Sequence
  spacer sequence
ugccucagccuccugaguag

SEQ ID NO: 6124 - RNA, 20 nt, Artificial Sequence
  spacer sequence
ccugccucagccuccugagu

SEQ ID NO: 6125 - RNA, 20 nt, Artificial Sequence
  spacer sequence
ugccauucuccugccucagc

SEQ ID NO: 6126 - RNA, 20 nt, Artificial Sequence
  spacer sequence
cagguucaugccauucuccu

SEQ ID NO: 6127 - RNA, 20 nt, Artificial Sequence
  spacer sequence
gccucccagguucaugccau

SEQ ID NO: 6128 - RNA, 20 nt, Artificial Sequence
  spacer sequence
cugcaagcuccgccucccag

SEQ ID NO: 6129 - RNA, 20 nt, Artificial Sequence
  spacer sequence
gcucacugcaagcuccgccu

SEQ ID NO: 6130 - RNA, 20 nt, Artificial Sequence
  spacer sequence
cggcucacugcaagcuccgc

SEQ ID NO: 6131 - RNA, 20 nt, Artificial Sequence
  spacer sequence
ugucacugcacuccagccug

SEQ ID NO: 6132 - RNA, 20 nt, Artificial Sequence
  spacer sequence
cugcacuccagccugggcga

SEQ ID NO: 6133 - RNA, 20 nt, Artificial Sequence
  spacer sequence
agccugggcgacagagcgag

SEQ ID NO: 6134 - RNA, 20 nt, Artificial Sequence
  spacer sequence
cccaggcuggagugcaguga

SEQ ID NO: 6135 - RNA, 20 nt, Artificial Sequence
  spacer sequence
gucgcccaggcuggagugca

SEQ ID NO: 6136 - RNA, 20 nt, Artificial Sequence
  spacer sequence
cucugucgcccaggcuggag

SEQ ID NO: 6137 - RNA, 20 nt, Artificial Sequence
  spacer sequence
cgcucugucgcccaggcugg

SEQ ID NO: 6138 - RNA, 20 nt, Artificial Sequence
  spacer sequence
ucucaaaaaaaaaaagaaaa

SEQ ID NO: 6139 - RNA, 20 nt, Artificial Sequence
  spacer sequence
caaaaaaaaaaagaaaaaaa

SEQ ID NO: 6140 - RNA, 20 nt, Artificial Sequence
  spacer sequence
aaaaaaaaaagaaaaaaacu

SEQ ID NO: 6141 - RNA, 20 nt, Artificial Sequence
  spacer sequence
uuuuuuuuuugagacgaguc

SEQ ID NO: 6142 - RNA, 20 nt, Artificial Sequence
  spacer sequence
uaaguuuuuuucuuuuuuuu

SEQ ID NO: 6143 - RNA, 20 nt, Artificial Sequence
  spacer sequence
aucauaaguuuuuuucuuuu

SEQ ID NO: 6144 - RNA, 20 nt, Artificial Sequence
  spacer sequence
cugaguggggaguggagagc

SEQ ID NO: 6145 - RNA, 20 nt, Artificial Sequence
  spacer sequence
gugaguguuuuuaagugucc

SEQ ID NO: 6146 - RNA, 20 nt, Artificial Sequence
  spacer sequence
ccacucagugaguguuuuua

SEQ ID NO: 6147 - RNA, 20 nt, Artificial Sequence
  spacer sequence
acuccccacucagugagugu

SEQ ID NO: 6148 - RNA, 20 nt, Artificial Sequence
  spacer sequence
ccacuccccacucagugagu

SEQ ID NO: 6149 - RNA, 20 nt, Artificial Sequence
  spacer sequence
caggguagccuguuggacau

SEQ ID NO: 6150 - RNA, 20 nt, Artificial Sequence
  spacer sequence
aacaggcuacccugggaccc

SEQ ID NO: 6151 - RNA, 20 nt, Artificial Sequence
  spacer sequence
agggcgacuuuuucuuuuuu

SEQ ID NO: 6152 - RNA, 20 nt, Artificial Sequence
  spacer sequence
cccuggaaauguccaacagg

SEQ ID NO: 6153 - RNA, 20 nt, Artificial Sequence
  spacer sequence
uuuuuuuuuuuuaaagucaa

SEQ ID NO: 6154 - RNA, 20 nt, Artificial Sequence
  spacer sequence
agugaguaugccauauggaa

SEQ ID NO: 6155 - RNA, 20 nt, Artificial Sequence
  spacer sequence
cuugacuuuaaaaaaaaaaa

SEQ ID NO: 6156 - RNA, 20 nt, Artificial Sequence
  spacer sequence
auauggcauacucacuugac

SEQ ID NO: 6157 - RNA, 20 nt, Artificial Sequence
  spacer sequence
acgcacacccuuuuccauau

SEQ ID NO: 6158 - RNA, 20 nt, Artificial Sequence
  spacer sequence
ccacgcacacccuuuuccau

SEQ ID NO: 6159 - RNA, 20 nt, Artificial Sequence
  spacer sequence
agaguguaggaugagacaua

SEQ ID NO: 6160 - RNA, 20 nt, Artificial Sequence
  spacer sequence
ggagccccuugcuuuuucuc

SEQ ID NO: 6161 - RNA, 20 nt, Artificial Sequence
  spacer sequence
uacacucuggagccccuugc

SEQ ID NO: 6162 - RNA, 20 nt, Artificial Sequence
  spacer sequence
uccuacacucuggagccccu

SEQ ID NO: 6163 - RNA, 20 nt, Artificial Sequence
  spacer sequence
cauccuacacucuggagccc

SEQ ID NO: 6164 - RNA, 20 nt, Artificial Sequence
  spacer sequence
gccuuuuuaacccaaaaggu

SEQ ID NO: 6165 - RNA, 20 nt, Artificial Sequence
  spacer sequence
ugccucagccuuuuuaaccc

SEQ ID NO: 6166 - RNA, 20 nt, Artificial Sequence
  spacer sequence
ccugccucagccuuuuuaac

SEQ ID NO: 6167 - RNA, 20 nt, Artificial Sequence
  spacer sequence
cgccauucuccugccucagc

SEQ ID NO: 6168 - RNA, 20 nt, Artificial Sequence
  spacer sequence
cggguucacgccauucuccu

SEQ ID NO: 6169 - RNA, 20 nt, Artificial Sequence
  spacer sequence
gccucccggguucacgccau

SEQ ID NO: 6170 - RNA, 20 nt, Artificial Sequence
  spacer sequence
cugcaagcuccgccucccgg

SEQ ID NO: 6171 - RNA, 20 nt, Artificial Sequence
  spacer sequence
gcucacugcaagcuccgccu

SEQ ID NO: 6172 - RNA, 20 nt, Artificial Sequence
  spacer sequence
cagcucacugcaagcuccgc

SEQ ID NO: 6173 - RNA, 20 nt, Artificial Sequence
  spacer sequence
ugccacugcacuccagccug

SEQ ID NO: 6174 - RNA, 20 nt, Artificial Sequence
  spacer sequence
agccugggcgacagagcgag

SEQ ID NO: 6175 - RNA, 20 nt, Artificial Sequence
  spacer sequence
cccaggcuggagugcagugg

SEQ ID NO: 6176 - RNA, 20 nt, Artificial Sequence
  spacer sequence
gucgcccaggcuggagugca

SEQ ID NO: 6177 - RNA, 20 nt, Artificial Sequence
  spacer sequence
cucugucgcccaggcuggag

SEQ ID NO: 6178 - RNA, 20 nt, Artificial Sequence
  spacer sequence
cgcucugucgcccaggcugg

SEQ ID NO: 6179 - RNA, 20 nt, Artificial Sequence
  spacer sequence
ugucucaaaauaaaaaacgu

SEQ ID NO: 6180 - RNA, 20 nt, Artificial Sequence
  spacer sequence
caaaauaaaaaacguuuaca

SEQ ID NO: 6181 - RNA, 20 nt, Artificial Sequence
  spacer sequence
aaauaaaaaacguuuacaug

SEQ ID NO: 6182 - RNA, 20 nt, Artificial Sequence
  spacer sequence
acauguacaaauauaaccua

SEQ ID NO: 6183 - RNA, 20 nt, Artificial Sequence
  spacer sequence
aaaguauuuacuacauaaau

SEQ ID NO: 6184 - RNA, 20 nt, Artificial Sequence
  spacer sequence
aagccuaugaaguaucuaac

SEQ ID NO: 6185 - RNA, 20 nt, Artificial Sequence
  spacer sequence
uaggcuuugacuauuacagu

SEQ ID NO: 6186 - RNA, 20 nt, Artificial Sequence
  spacer sequence
aacacugauguguagguacu

SEQ ID NO: 6187 - RNA, 20 nt, Artificial Sequence
  spacer sequence
guguuagauacuucauaggc

SEQ ID NO: 6188 - RNA, 20 nt, Artificial Sequence
  spacer sequence
cuuugcuugccacucuauua

SEQ ID NO: 6189 - RNA, 20 nt, Artificial Sequence
  spacer sequence
auuaggugcuuuuuauguua

SEQ ID NO: 6190 - RNA, 20 nt, Artificial Sequence
  spacer sequence
ugaagccuggccacagggug

SEQ ID NO: 6191 - RNA, 20 nt, Artificial Sequence
  spacer sequence
ugauuaaauaacauaaaaag

SEQ ID NO: 6192 - RNA, 20 nt, Artificial Sequence
  spacer sequence
augcacaagcacccuguggc

SEQ ID NO: 6193 - RNA, 20 nt, Artificial Sequence
  spacer sequence
cacacucaaugcacaagcac

SEQ ID NO: 6194 - RNA, 20 nt, Artificial Sequence
  spacer sequence
uguucccacacucaaugcac

SEQ ID NO: 6195 - RNA, 20 nt, Artificial Sequence
  spacer sequence
cccuuuugaggacacaggcc

SEQ ID NO: 6196 - RNA, 20 nt, Artificial Sequence
  spacer sequence
cuuuugaggacacaggccua

SEQ ID NO: 6197 - RNA, 20 nt, Artificial Sequence
  spacer sequence
aaagggagaugguaaucuug

SEQ ID NO: 6198 - RNA, 20 nt, Artificial Sequence
  spacer sequence
ucaaaagggagaugguaauc

SEQ ID NO: 6199 - RNA, 20 nt, Artificial Sequence
  spacer sequence
aggccuguguccucaaaagg

SEQ ID NO: 6200 - RNA, 20 nt, Artificial Sequence
  spacer sequence
agcaagcugcuuaacugcuc

SEQ ID NO: 6201 - RNA, 20 nt, Artificial Sequence
  spacer sequence
cuggcuagaaaguggucagc

SEQ ID NO: 6202 - RNA, 20 nt, Artificial Sequence
  spacer sequence
agccagugaaccuccagcaa

SEQ ID NO: 6203 - RNA, 20 nt, Artificial Sequence
  spacer sequence
gccugggauuuggacacaga

SEQ ID NO: 6204 - RNA, 20 nt, Artificial Sequence
  spacer sequence
caggcugaccacuuucuagc

SEQ ID NO: 6205 - RNA, 20 nt, Artificial Sequence
  spacer sequence
aaaucccaggcugaccacuu

SEQ ID NO: 6206 - RNA, 20 nt, Artificial Sequence
  spacer sequence
guguccaaaucccaggcuga

SEQ ID NO: 6207 - RNA, 20 nt, Artificial Sequence
  spacer sequence
acucccaagucuggcugcuu

SEQ ID NO: 6208 - RNA, 20 nt, Artificial Sequence
  spacer sequence
caagucuggcugcuuuuuac

SEQ ID NO: 6209 - RNA, 20 nt, Artificial Sequence
  spacer sequence
ggcugcuuuuuacuucacug

SEQ ID NO: 6210 - RNA, 20 nt, Artificial Sequence
  spacer sequence
cugugagggguaaagguaaa

SEQ ID NO: 6211 - RNA, 20 nt, Artificial Sequence
  spacer sequence
cagugaaguaaaaagcagcc

SEQ ID NO: 6212 - RNA, 20 nt, Artificial Sequence
  spacer sequence
gcuguuuucuuuguucagaa

SEQ ID NO: 6213 - RNA, 20 nt, Artificial Sequence
  spacer sequence
uuguucagaaacucucucca

SEQ ID NO: 6214 - RNA, 20 nt, Artificial Sequence
  spacer sequence
gaaacucucuccaacuuugc

SEQ ID NO: 6215 - RNA, 20 nt, Artificial Sequence
  spacer sequence
gaacaaagaaaacagcugau

SEQ ID NO: 6216 - RNA, 20 nt, Artificial Sequence
  spacer sequence
cuccaacuuugcacuuuucu

SEQ ID NO: 6217 - RNA, 20 nt, Artificial Sequence
  spacer sequence
ccaacuuugcacuuuucuua

SEQ ID NO: 6218 - RNA, 20 nt, Artificial Sequence
  spacer sequence
aacuuugcacuuuucuuaaa

SEQ ID NO: 6219 - RNA, 20 nt, Artificial Sequence
  spacer sequence
uaaaggaaaguaauggacca

SEQ ID NO: 6220 - RNA, 20 nt, Artificial Sequence
  spacer sequence
uuuaagaaaagugcaaaguu

SEQ ID NO: 6221 - RNA, 20 nt, Artificial Sequence
  spacer sequence
auuacuuuccuuuaagaaaa

SEQ ID NO: 6222 - RNA, 20 nt, Artificial Sequence
  spacer sequence
cugguccauuacuuuccuuu

SEQ ID NO: 6223 - RNA, 20 nt, Artificial Sequence
  spacer sequence
ccacaccuucacugguccau

SEQ ID NO: 6224 - RNA, 20 nt, Artificial Sequence
  spacer sequence
uuuaaugcuuccccacaccu

SEQ ID NO: 6225 - RNA, 20 nt, Artificial Sequence
  spacer sequence
guccuuuaaugcuuccccac

SEQ ID NO: 6226 - RNA, 20 nt, Artificial Sequence
  spacer sequence
gucaguccuuuaaugcuucc

SEQ ID NO: 6227 - RNA, 20 nt, Artificial Sequence
  spacer sequence
augcaggccuucagucaguc

SEQ ID NO: 6228 - RNA, 20 nt, Artificial Sequence
  spacer sequence
auguucaugaguuuggagau

SEQ ID NO: 6229 - RNA, 20 nt, Artificial Sequence
  spacer sequence
ugaguuuggagauaauacag

SEQ ID NO: 6230 - RNA, 20 nt, Artificial Sequence
  spacer sequence
ugaacauggaauccaugcag

SEQ ID NO: 6231 - RNA, 20 nt, Artificial Sequence
  spacer sequence
aaacucaugaacauggaauc

SEQ ID NO: 6232 - RNA, 20 nt, Artificial Sequence
  spacer sequence
ccaaacucaugaacauggaa

SEQ ID NO: 6233 - RNA, 20 nt, Artificial Sequence
  spacer sequence
ccagcacagcacaacaccca

SEQ ID NO: 6234 - RNA, 20 nt, Artificial Sequence
  spacer sequence
cccuaguuagauaaacagua

SEQ ID NO: 6235 - RNA, 20 nt, Artificial Sequence
  spacer sequence
aacuagggugaacaaguaug

SEQ ID NO: 6236 - RNA, 20 nt, Artificial Sequence
  spacer sequence
acuguuuaucuaacuagggu

SEQ ID NO: 6237 - RNA, 20 nt, Artificial Sequence
  spacer sequence
acuuguuuuuguuuuugaga

SEQ ID NO: 6238 - RNA, 20 nt, Artificial Sequence
  spacer sequence
aaaacaaaaacaaguugagg

SEQ ID NO: 6239 - RNA, 20 nt, Artificial Sequence
  spacer sequence
caaaaacaaaaacaaguuga

SEQ ID NO: 6240 - RNA, 20 nt, Artificial Sequence
  spacer sequence
ugcucugucgcucaggcugg

SEQ ID NO: 6241 - RNA, 20 nt, Artificial Sequence
  spacer sequence
gucgcucaggcuggagugca

SEQ ID NO: 6242 - RNA, 20 nt, Artificial Sequence
  spacer sequence
cucaggcuggagugcagugg

SEQ ID NO: 6243 - RNA, 20 nt, Artificial Sequence
  spacer sequence
ggcuggagugcaguggcgcu

SEQ ID NO: 6244 - RNA, 20 nt, Artificial Sequence
  spacer sequence
agccugagcgacagagcaag

SEQ ID NO: 6245 - RNA, 20 nt, Artificial Sequence
  spacer sequence
cacagcgccacugcacucca

SEQ ID NO: 6246 - RNA, 20 nt, Artificial Sequence
  spacer sequence
uggcugaccuuagccuugac

SEQ ID NO: 6247 - RNA, 20 nt, Artificial Sequence
  spacer sequence
gccaugaucgcacagcgcca

SEQ ID NO: 6248 - RNA, 20 nt, Artificial Sequence
  spacer sequence
aggcuaaggucagccaugau

SEQ ID NO: 6249 - RNA, 20 nt, Artificial Sequence
  spacer sequence
caggcuccauugauccucau

SEQ ID NO: 6250 - RNA, 20 nt, Artificial Sequence
  spacer sequence
auugauccucaugccuuggc

SEQ ID NO: 6251 - RNA, 20 nt, Artificial Sequence
  spacer sequence
auggagccugggaggucaag

SEQ ID NO: 6252 - RNA, 20 nt, Artificial Sequence
  spacer sequence
ucaugccuuggcccguagcu

SEQ ID NO: 6253 - RNA, 20 nt, Artificial Sequence
  spacer sequence
ugccuuggcccguagcuggg

SEQ ID NO: 6254 - RNA, 20 nt, Artificial Sequence
  spacer sequence
cagcuacgggccaaggcaug

SEQ ID NO: 6255 - RNA, 20 nt, Artificial Sequence
  spacer sequence
agaggugggguuucaucaug

SEQ ID NO: 6256 - RNA, 20 nt, Artificial Sequence
  spacer sequence
agaaaaaaauacaaaaauua

SEQ ID NO: 6257 - RNA, 20 nt, Artificial Sequence
  spacer sequence
ucauguugcccaggcugguc

SEQ ID NO: 6258 - RNA, 20 nt, Artificial Sequence
  spacer sequence
uguugcccaggcuggucuug

SEQ ID NO: 6259 - RNA, 20 nt, Artificial Sequence
  spacer sequence
ugaacugcugggcucaagug

SEQ ID NO: 6260 - RNA, 20 nt, Artificial Sequence
  spacer sequence
agaccagccugggcaacaug

SEQ ID NO: 6261 - RNA, 20 nt, Artificial Sequence
  spacer sequence
aguggucuauccuccucgac

SEQ ID NO: 6262 - RNA, 20 nt, Artificial Sequence
  spacer sequence
auccuccucgaccucccaaa

SEQ ID NO: 6263 - RNA, 20 nt, Artificial Sequence
  spacer sequence
uccucgaccucccaaagugc

SEQ ID NO: 6264 - RNA, 20 nt, Artificial Sequence
  spacer sequence
ucgaccucccaaagugcugg

SEQ ID NO: 6265 - RNA, 20 nt, Artificial Sequence
  spacer sequence
accucccaaagugcugggau

SEQ ID NO: 6266 - RNA, 20 nt, Artificial Sequence
  spacer sequence
aggaggauagaccacuugag

SEQ ID NO: 6267 - RNA, 20 nt, Artificial Sequence
  spacer sequence
caaagugcugggauuacaug

SEQ ID NO: 6268 - RNA, 20 nt, Artificial Sequence
  spacer sequence
cagcacuuugggaggucgag

SEQ ID NO: 6269 - RNA, 20 nt, Artificial Sequence
  spacer sequence
cacauguaaucccagcacuu

SEQ ID NO: 6270 - RNA, 20 nt, Artificial Sequence
  spacer sequence
caggcacaguggcucacaca

SEQ ID NO: 6271 - RNA, 20 nt, Artificial Sequence
  spacer sequence
acuuuucuuuuaaaaaagag

SEQ ID NO: 6272 - RNA, 20 nt, Artificial Sequence
  spacer sequence
uuuaaaaaagaggucaacuu

SEQ ID NO: 6273 - RNA, 20 nt, Artificial Sequence
  spacer sequence
uuuuuaaaagaaaaguugag

SEQ ID NO: 6274 - RNA, 20 nt, Artificial Sequence
  spacer sequence
acuuuauuguauauaagcac

SEQ ID NO: 6275 - RNA, 20 nt, Artificial Sequence
  spacer sequence
ugcaauuuuagcacagugcu

SEQ ID NO: 6276 - RNA, 20 nt, Artificial Sequence
  spacer sequence
caguuccugcaauuuuagca

SEQ ID NO: 6277 - RNA, 20 nt, Artificial Sequence
  spacer sequence
ugauuuuuguaauaaugcca

SEQ ID NO: 6278 - RNA, 20 nt, Artificial Sequence
  spacer sequence
ggauauggucccaguuccug

SEQ ID NO: 6279 - RNA, 20 nt, Artificial Sequence
  spacer sequence
gcuggcauuauuacaaaaau

SEQ ID NO: 6280 - RNA, 20 nt, Artificial Sequence
  spacer sequence
uguguguacucugcuggcau

SEQ ID NO: 6281 - RNA, 20 nt, Artificial Sequence
  spacer sequence
agugcaguuacuuuucuugu

SEQ ID NO: 6282 - RNA, 20 nt, Artificial Sequence
  spacer sequence
caaucuagugcaguuacuuu

SEQ ID NO: 6283 - RNA, 20 nt, Artificial Sequence
  spacer sequence
ucacaaucuagugcaguuac

SEQ ID NO: 6284 - RNA, 20 nt, Artificial Sequence
  spacer sequence
accccagucuucacaaucua

SEQ ID NO: 6285 - RNA, 20 nt, Artificial Sequence
  spacer sequence
gaagguccagugcccuuugu

SEQ ID NO: 6286 - RNA, 20 nt, Artificial Sequence
  spacer sequence
gaagcagguccaccccaguc

SEQ ID NO: 6287 - RNA, 20 nt, Artificial Sequence
  spacer sequence
agugcccuuugucuuaagau

SEQ ID NO: 6288 - RNA, 20 nt, Artificial Sequence
  spacer sequence
uaagauuugguguagugugu

SEQ ID NO: 6289 - RNA, 20 nt, Artificial Sequence
  spacer sequence
uaagacaaagggcacuggac

SEQ ID NO: 6290 - RNA, 20 nt, Artificial Sequence
  spacer sequence
uuagaaaccaaaaaaagaga

SEQ ID NO: 6291 - RNA, 20 nt, Artificial Sequence
  spacer sequence
aaagacacacuacaccaaau

SEQ ID NO: 6292 - RNA, 20 nt, Artificial Sequence
  spacer sequence
uuuuuugguuucuaaagaca

SEQ ID NO: 6293 - RNA, 20 nt, Artificial Sequence
  spacer sequence
cuuuuuuugguuucuaaaga

SEQ ID NO: 6294 - RNA, 20 nt, Artificial Sequence
  spacer sequence
ucucuuuuuuugguuucuaa

SEQ ID NO: 6295 - RNA, 20 nt, Artificial Sequence
  spacer sequence
ucuucucuuuuuuugguuuc

SEQ ID NO: 6296 - RNA, 20 nt, Artificial Sequence
  spacer sequence
accuuaagauuagccacaaa

SEQ ID NO: 6297 - RNA, 20 nt, Artificial Sequence
  spacer sequence
uaagguugaucuucuucucu

SEQ ID NO: 6298 - RNA, 20 nt, Artificial Sequence
  spacer sequence
aagcccaguuuuguggcuaa

SEQ ID NO: 6299 - RNA, 20 nt, Artificial Sequence
  spacer sequence
acaccuagguaucaaagccc

SEQ ID NO: 6300 - RNA, 20 nt, Artificial Sequence
  spacer sequence
uuuccacaccuagguaucaa

SEQ ID NO: 6301 - RNA, 20 nt, Artificial Sequence
  spacer sequence
cuuucuuuuccacaccuagg

SEQ ID NO: 6302 - RNA, 20 nt, Artificial Sequence
  spacer sequence
uucccuuucuuuuccacacc

SEQ ID NO: 6303 - RNA, 20 nt, Artificial Sequence
  spacer sequence
acucuuucccuuucuuuucc

SEQ ID NO: 6304 - RNA, 20 nt, Artificial Sequence
  spacer sequence
uacagcaucauuguagaaga

SEQ ID NO: 6305 - RNA, 20 nt, Artificial Sequence
  spacer sequence
uuguagaagaggguguuuuu

SEQ ID NO: 6306 - RNA, 20 nt, Artificial Sequence
  spacer sequence
acaaugaugcuguaagacaa

SEQ ID NO: 6307 - RNA, 20 nt, Artificial Sequence
  spacer sequence
ucuacaaugaugcuguaaga

SEQ ID NO: 6308 - RNA, 20 nt, Artificial Sequence
  spacer sequence
aaaaacaaacaaacaaaaaa

SEQ ID NO: 6309 - RNA, 20 nt, Artificial Sequence
  spacer sequence
caaaaaacaaacaaacaaaa

SEQ ID NO: 6310 - RNA, 20 nt, Artificial Sequence
  spacer sequence
gucucaaaaaacaaacaaac

SEQ ID NO: 6311 - RNA, 20 nt, Artificial Sequence
  spacer sequence
uacucuguggcccaggcugg

SEQ ID NO: 6312 - RNA, 20 nt, Artificial Sequence
  spacer sequence
guggcccaggcuggagugca

SEQ ID NO: 6313 - RNA, 20 nt, Artificial Sequence
  spacer sequence
agccugggccacagaguaag

SEQ ID NO: 6314 - RNA, 20 nt, Artificial Sequence
  spacer sequence
cgccacugcacuccagccug

SEQ ID NO: 6315 - RNA, 20 nt, Artificial Sequence
  spacer sequence
cggcucacugcaagcuccgc

SEQ ID NO: 6316 - RNA, 20 nt, Artificial Sequence
  spacer sequence
gcucacugcaagcuccgccu

SEQ ID NO: 6317 - RNA, 20 nt, Artificial Sequence
  spacer sequence
cugcaagcuccgccucccgg

SEQ ID NO: 6318 - RNA, 20 nt, Artificial Sequence
  spacer sequence
gccucccggguucaugccau

SEQ ID NO: 6319 - RNA, 20 nt, Artificial Sequence
  spacer sequence
cggguucaugccauucuccu

SEQ ID NO: 6320 - RNA, 20 nt, Artificial Sequence
  spacer sequence
ugccauucuccugccucagc

SEQ ID NO: 6321 - RNA, 20 nt, Artificial Sequence
  spacer sequence
ccugccucagcccccugagu

SEQ ID NO: 6322 - RNA, 20 nt, Artificial Sequence
  spacer sequence
ugccucagcccccugaguag

SEQ ID NO: 6323 - RNA, 20 nt, Artificial Sequence
  spacer sequence
gcccccugaguagcugggac

SEQ ID NO: 6324 - RNA, 20 nt, Artificial Sequence
  spacer sequence
gggggcugaggcaggagaau

SEQ ID NO: 6325 - RNA, 20 nt, Artificial Sequence
  spacer sequence
cagcuacucagggggcugag

SEQ ID NO: 6326 - RNA, 20 nt, Artificial Sequence
  spacer sequence
acuaaaaauacaaaaaauua

SEQ ID NO: 6327 - RNA, 20 nt, Artificial Sequence
  spacer sequence
cuacuaaaaauacaaaaaau

SEQ ID NO: 6328 - RNA, 20 nt, Artificial Sequence
  spacer sequence
cuguguuagccaagaugguc

SEQ ID NO: 6329 - RNA, 20 nt, Artificial Sequence
  spacer sequence
uggcuaacacagugaaaccc

SEQ ID NO: 6330 - RNA, 20 nt, Artificial Sequence
  spacer sequence
cucuccugaccucgugaucc

SEQ ID NO: 6331 - RNA, 20 nt, Artificial Sequence
  spacer sequence
cuccugaccucgugauccgc

SEQ ID NO: 6332 - RNA, 20 nt, Artificial Sequence
  spacer sequence
ccugaccucgugauccgccu

SEQ ID NO: 6333 - RNA, 20 nt, Artificial Sequence
  spacer sequence
ugaccucgugauccgccugu

SEQ ID NO: 6334 - RNA, 20 nt, Artificial Sequence
  spacer sequence
ggagagagaccaucuuggcu

SEQ ID NO: 6335 - RNA, 20 nt, Artificial Sequence
  spacer sequence
ugauccgccugucucagccu

SEQ ID NO: 6336 - RNA, 20 nt, Artificial Sequence
  spacer sequence
cgaggucaggagagagacca

SEQ ID NO: 6337 - RNA, 20 nt, Artificial Sequence
  spacer sequence
gccugucucagccucccaaa

SEQ ID NO: 6338 - RNA, 20 nt, Artificial Sequence
  spacer sequence
cagccucccaaagugcuggg

SEQ ID NO: 6339 - RNA, 20 nt, Artificial Sequence
  spacer sequence
gccucccaaagugcugggau

SEQ ID NO: 6340 - RNA, 20 nt, Artificial Sequence
  spacer sequence
caaagugcugggauuacagg

SEQ ID NO: 6341 - RNA, 20 nt, Artificial Sequence
  spacer sequence
cagcacuuugggaggcugag

SEQ ID NO: 6342 - RNA, 20 nt, Artificial Sequence
  spacer sequence
ugccuguaaucccagcacuu

SEQ ID NO: 6343 - RNA, 20 nt, Artificial Sequence
  spacer sequence
ggcugggugcgguggcucau

SEQ ID NO: 6344 - RNA, 20 nt, Artificial Sequence
  spacer sequence
ucuggcugggugcgguggcu

SEQ ID NO: 6345 - RNA, 20 nt, Artificial Sequence
  spacer sequence
uuaaaaaacacccucuucug

SEQ ID NO: 6346 - RNA, 20 nt, Artificial Sequence
  spacer sequence
uauuugccuucuuuaaaaaa

SEQ ID NO: 6347 - RNA, 20 nt, Artificial Sequence
  spacer sequence
uaacuuuuguaaugauccca

SEQ ID NO: 6348 - RNA, 20 nt, Artificial Sequence
  spacer sequence
uuacaaaaguuaagagccca

SEQ ID NO: 6349 - RNA, 20 nt, Artificial Sequence
  spacer sequence
cagguguuugagcugggggu

SEQ ID NO: 6350 - RNA, 20 nt, Artificial Sequence
  spacer sequence
aacaccugggaucauuacaa

SEQ ID NO: 6351 - RNA, 20 nt, Artificial Sequence
  spacer sequence
acccccagcucaaacaccug

SEQ ID NO: 6352 - RNA, 20 nt, Artificial Sequence
  spacer sequence
agcaaaggggcugcauuuau

SEQ ID NO: 6353 - RNA, 20 nt, Artificial Sequence
  spacer sequence
aggcacccacccucaacccc

SEQ ID NO: 6354 - RNA, 20 nt, Artificial Sequence
  spacer sequence
uacauggcauuaugcaaaua

SEQ ID NO: 6355 - RNA, 20 nt, Artificial Sequence
  spacer sequence
acaccccaaacacaggcuuc

SEQ ID NO: 6356 - RNA, 20 nt, Artificial Sequence
  spacer sequence
uagugggaccaaaguaugau

SEQ ID NO: 6357 - RNA, 20 nt, Artificial Sequence
  spacer sequence
cacuaagaagccuguguuug

SEQ ID NO: 6358 - RNA, 20 nt, Artificial Sequence
  spacer sequence
uacuuuggucccacuaagaa

SEQ ID NO: 6359 - RNA, 20 nt, Artificial Sequence
  spacer sequence
guuuguaucauacuuugguc

SEQ ID NO: 6360 - RNA, 20 nt, Artificial Sequence
  spacer sequence
ucaguuuguaucauacuuug

SEQ ID NO: 6361 - RNA, 20 nt, Artificial Sequence
  spacer sequence
aucuucaguuuguaucauac

SEQ ID NO: 6362 - RNA, 20 nt, Artificial Sequence
  spacer sequence
gcauuccaucuucaguuugu

SEQ ID NO: 6363 - RNA, 20 nt, Artificial Sequence
  spacer sequence
ucugcauuccaucuucaguu

SEQ ID NO: 6364 - RNA, 20 nt, Artificial Sequence
  spacer sequence
aaaguaccaauaauccucug

SEQ ID NO: 6365 - RNA, 20 nt, Artificial Sequence
  spacer sequence
ggcaaccccugaaccagagu

SEQ ID NO: 6366 - RNA, 20 nt, Artificial Sequence
  spacer sequence
gggguugccugauuuuuuaa

SEQ ID NO: 6367 - RNA, 20 nt, Artificial Sequence
  spacer sequence
gguucagggguugccugauu

SEQ ID NO: 6368 - RNA, 20 nt, Artificial Sequence
  spacer sequence
gagaaacugccaaauuuuau

SEQ ID NO: 6369 - RNA, 20 nt, Artificial Sequence
  spacer sequence
gaaccuacucugguucaggg

SEQ ID NO: 6370 - RNA, 20 nt, Artificial Sequence
  spacer sequence
cugaaccuacucugguucag

SEQ ID NO: 6371 - RNA, 20 nt, Artificial Sequence
  spacer sequence
uaauuugggauuggaagcaa

SEQ ID NO: 6372 - RNA, 20 nt, Artificial Sequence
  spacer sequence
caaauuaagaaaauaaaauu

SEQ ID NO: 6373 - RNA, 20 nt, Artificial Sequence
  spacer sequence
aaucccaaauuaagaaaaua

SEQ ID NO: 6374 - RNA, 20 nt, Artificial Sequence
  spacer sequence
guuaacuugcuuccaauccc

SEQ ID NO: 6375 - RNA, 20 nt, Artificial Sequence
  spacer sequence
uaaacuucuguuaacuugcu

SEQ ID NO: 6376 - RNA, 20 nt, Artificial Sequence
  spacer sequence
cuaaaugcaacuuaacucau

SEQ ID NO: 6377 - RNA, 20 nt, Artificial Sequence
  spacer sequence
uuugccauauuugaguaaua

SEQ ID NO: 6378 - RNA, 20 nt, Artificial Sequence
  spacer sequence
aauauggcaaaagaucacua

SEQ ID NO: 6379 - RNA, 20 nt, Artificial Sequence
  spacer sequence
gauuuuuuuguuuauagauu

SEQ ID NO: 6380 - RNA, 20 nt, Artificial Sequence
  spacer sequence
gauuauuacucaaauauggc

SEQ ID NO: 6381 - RNA, 20 nt, Artificial Sequence
  spacer sequence
auaaacaaaaaaaucagauu

SEQ ID NO: 6382 - RNA, 20 nt, Artificial Sequence
  spacer sequence
ucuuaaauuaacuuuauuca

SEQ ID NO: 6383 - RNA, 20 nt, Artificial Sequence
  spacer sequence
uaaauuaacuuuauucaucu

SEQ ID NO: 6384 - RNA, 20 nt, Artificial Sequence
  spacer sequence
ucuugcuaauuuaguuucaa

SEQ ID NO: 6385 - RNA, 20 nt, Artificial Sequence
  spacer sequence
ugcuaauuuaguuucaaaua

SEQ ID NO: 6386 - RNA, 20 nt, Artificial Sequence
  spacer sequence
aauagugauuuguaaugauc

SEQ ID NO: 6387 - RNA, 20 nt, Artificial Sequence
  spacer sequence
cuauuugaaacuaaauuagc

SEQ ID NO: 6388 - RNA, 20 nt, Artificial Sequence
  spacer sequence
uuacaaaucacuauuugaaa

SEQ ID NO: 6389 - RNA, 20 nt, Artificial Sequence
  spacer sequence
gauuugauccauuucuguaa

SEQ ID NO: 6390 - RNA, 20 nt, Artificial Sequence
  spacer sequence
gaucauuacaaaucacuauu

SEQ ID NO: 6391 - RNA, 20 nt, Artificial Sequence
  spacer sequence
aaucugaucauuacaaauca

SEQ ID NO: 6392 - RNA, 20 nt, Artificial Sequence
  spacer sequence
auuucuguaauugcugaaau

SEQ ID NO: 6393 - RNA, 20 nt, Artificial Sequence
  spacer sequence
guaauugcugaaauuccccc

SEQ ID NO: 6394 - RNA, 20 nt, Artificial Sequence
  spacer sequence
gcaauuacagaaauggauca

SEQ ID NO: 6395 - RNA, 20 nt, Artificial Sequence
  spacer sequence
cccgaguugcuuuuuggcuu

SEQ ID NO: 6396 - RNA, 20 nt, Artificial Sequence
  spacer sequence
ggggaauuucagcaauuaca

SEQ ID NO: 6397 - RNA, 20 nt, Artificial Sequence
  spacer sequence
ggucugggaggugauugcuc

SEQ ID NO: 6398 - RNA, 20 nt, Artificial Sequence
  spacer sequence
gggaggugauugcucugcug

SEQ ID NO: 6399 - RNA, 20 nt, Artificial Sequence
  spacer sequence
cagaccagaggcgguaaagc

SEQ ID NO: 6400 - RNA, 20 nt, Artificial Sequence
  spacer sequence
ccucccagaccagaggcggu

SEQ ID NO: 6401 - RNA, 20 nt, Artificial Sequence
  spacer sequence
gcugcuuccuguaacuugcc

SEQ ID NO: 6402 - RNA, 20 nt, Artificial Sequence
  spacer sequence
uguaacuugccugccuuucu

SEQ ID NO: 6403 - RNA, 20 nt, Artificial Sequence
  spacer sequence
cccugugugggacuccugcg

SEQ ID NO: 6404 - RNA, 20 nt, Artificial Sequence
  spacer sequence
cugugugggacuccugcggg

SEQ ID NO: 6405 - RNA, 20 nt, Artificial Sequence
  spacer sequence
cacacagggagaaaggcagg

SEQ ID NO: 6406 - RNA, 20 nt, Artificial Sequence
  spacer sequence
ugcgggugagagcguggcug

SEQ ID NO: 6407 - RNA, 20 nt, Artificial Sequence
  spacer sequence
cccgcaggagucccacacag

SEQ ID NO: 6408 - RNA, 20 nt, Artificial Sequence
  spacer sequence
cacccgcaggagucccacac

SEQ ID NO: 6409 - RNA, 20 nt, Artificial Sequence
  spacer sequence
gccacgcucucacccgcagg

SEQ ID NO: 6410 - RNA, 20 nt, Artificial Sequence
  spacer sequence
ucagccacgcucucacccgc

SEQ ID NO: 6411 - RNA, 20 nt, Artificial Sequence
  spacer sequence
uaacacggcugucuucagcc

SEQ ID NO: 6412 - RNA, 20 nt, Artificial Sequence
  spacer sequence
ugugcugucgagguugugcu

SEQ ID NO: 6413 - RNA, 20 nt, Artificial Sequence
  spacer sequence
agguugugcucugugaaugu

SEQ ID NO: 6414 - RNA, 20 nt, Artificial Sequence
  spacer sequence
acagcacaggaggcccuuuc

SEQ ID NO: 6415 - RNA, 20 nt, Artificial Sequence
  spacer sequence
gugaaugucauccccuggug

SEQ ID NO: 6416 - RNA, 20 nt, Artificial Sequence
  spacer sequence
cagagcacaaccucgacagc

SEQ ID NO: 6417 - RNA, 20 nt, Artificial Sequence
  spacer sequence
uccccuggugcacagcagca

SEQ ID NO: 6418 - RNA, 20 nt, Artificial Sequence
  spacer sequence
ccuggugcacagcagcaccu

SEQ ID NO: 6419 - RNA, 20 nt, Artificial Sequence
  spacer sequence
acacaggauacaguuggaau

SEQ ID NO: 6420 - RNA, 20 nt, Artificial Sequence
  spacer sequence
uguguagaaggugcugcugu

SEQ ID NO: 6421 - RNA, 20 nt, Artificial Sequence
  spacer sequence
aacuguauccuguguagaag

SEQ ID NO: 6422 - RNA, 20 nt, Artificial Sequence
  spacer sequence
aguuguguaaggcagcagcc

SEQ ID NO: 6423 - RNA, 20 nt, Artificial Sequence
  spacer sequence
agggggcggcauuccaacug

SEQ ID NO: 6424 - RNA, 20 nt, Artificial Sequence
  spacer sequence
uaugugcaagggccaaggcu

SEQ ID NO: 6425 - RNA, 20 nt, Artificial Sequence
  spacer sequence
acagcaucuuaugugcaagg

SEQ ID NO: 6426 - RNA, 20 nt, Artificial Sequence
  spacer sequence
gccugcaccaaguaaagggc

SEQ ID NO: 6427 - RNA, 20 nt, Artificial Sequence
  spacer sequence
gugcccuuuacuuggugcag

SEQ ID NO: 6428 - RNA, 20 nt, Artificial Sequence
  spacer sequence
aucugugcccuuuacuuggu

SEQ ID NO: 6429 - RNA, 20 nt, Artificial Sequence
  spacer sequence
ccagcaacauaugccaagca

SEQ ID NO: 6430 - RNA, 20 nt, Artificial Sequence
  spacer sequence
ccccagcaacauaugccaag

SEQ ID NO: 6431 - RNA, 20 nt, Artificial Sequence
  spacer sequence
ucuccccagcaacauaugcc

SEQ ID NO: 6432 - RNA, 20 nt, Artificial Sequence
  spacer sequence
uaagaauuuggaucauaacc

SEQ ID NO: 6433 - RNA, 20 nt, Artificial Sequence
  spacer sequence
uaagaacguaguauacuuua

SEQ ID NO: 6434 - RNA, 20 nt, Artificial Sequence
  spacer sequence
aaauucuuaagaacguagua

SEQ ID NO: 6435 - RNA, 20 nt, Artificial Sequence
  spacer sequence
uaaccaugggauuuuaauaa

SEQ ID NO: 6436 - RNA, 20 nt, Artificial Sequence
  spacer sequence
caugguuaugauccaaauuc

SEQ ID NO: 6437 - RNA, 20 nt, Artificial Sequence
  spacer sequence
auuauuaaaaucccaugguu

SEQ ID NO: 6438 - RNA, 20 nt, Artificial Sequence
  spacer sequence
acaguuuuucuauuauuaaa

SEQ ID NO: 6439 - RNA, 20 nt, Artificial Sequence
  spacer sequence
ucaacaguuuuucuauuauu

SEQ ID NO: 6440 - RNA, 20 nt, Artificial Sequence
  spacer sequence
gucuggucccuuauuuuuac

SEQ ID NO: 6441 - RNA, 20 nt, Artificial Sequence
  spacer sequence
ggucccuuauuuuuacagug

SEQ ID NO: 6442 - RNA, 20 nt, Artificial Sequence
  spacer sequence
cuuauuuuuacagugaagaa

SEQ ID NO: 6443 - RNA, 20 nt, Artificial Sequence
  spacer sequence
cuguaaaaauaagggaccag

SEQ ID NO: 6444 - RNA, 20 nt, Artificial Sequence
  spacer sequence
ucacuguaaaaauaagggac

SEQ ID NO: 6445 - RNA, 20 nt, Artificial Sequence
  spacer sequence
gggcuuuggcuucuucacug

SEQ ID NO: 6446 - RNA, 20 nt, Artificial Sequence
  spacer sequence
cugggcuuuggcuucuucac

SEQ ID NO: 6447 - RNA, 20 nt, Artificial Sequence
  spacer sequence
gacaguaguuagaacuuggu

SEQ ID NO: 6448 - RNA, 20 nt, Artificial Sequence
  spacer sequence
gacacuuguaaaguuaacac

SEQ ID NO: 6449 - RNA, 20 nt, Artificial Sequence
  spacer sequence
aacuacugucugacacuugu

SEQ ID NO: 6450 - RNA, 20 nt, Artificial Sequence
  spacer sequence
aaaaaaaaaaaaaaaaaacc

SEQ ID NO: 6451 - RNA, 20 nt, Artificial Sequence
  spacer sequence
caaaaaaaaaaaaaaaaaaa

SEQ ID NO: 6452 - RNA, 20 nt, Artificial Sequence
  spacer sequence
aucucaaaaaaaaaaaaaaa

SEQ ID NO: 6453 - RNA, 20 nt, Artificial Sequence
  spacer sequence
ugcucuguugcccaggcugg

SEQ ID NO: 6454 - RNA, 20 nt, Artificial Sequence
  spacer sequence
guugcccaggcuggagugca

SEQ ID NO: 6455 - RNA, 20 nt, Artificial Sequence
  spacer sequence
agccugggcaacagagcaag

SEQ ID NO: 6456 - RNA, 20 nt, Artificial Sequence
  spacer sequence
caccacugcacuccagccug

SEQ ID NO: 6457 - RNA, 20 nt, Artificial Sequence
  spacer sequence
cagcucacugcaaccucugc

SEQ ID NO: 6458 - RNA, 20 nt, Artificial Sequence
  spacer sequence
gcucacugcaaccucugccu

SEQ ID NO: 6459 - RNA, 20 nt, Artificial Sequence
  spacer sequence
cugcaaccucugccucccag

SEQ ID NO: 6460 - RNA, 20 nt, Artificial Sequence
  spacer sequence
gccucccagguucaagcgau

SEQ ID NO: 6461 - RNA, 20 nt, Artificial Sequence
  spacer sequence
cagguucaagcgauucuccu

SEQ ID NO: 6462 - RNA, 20 nt, Artificial Sequence
  spacer sequence
agcgauucuccugccucagc

SEQ ID NO: 6463 - RNA, 20 nt, Artificial Sequence
  spacer sequence
cuugaaccugggaggcagag

SEQ ID NO: 6464 - RNA, 20 nt, Artificial Sequence
  spacer sequence
ccugccucagccuacuaagu

SEQ ID NO: 6465 - RNA, 20 nt, Artificial Sequence
  spacer sequence
ugccucagccuacuaaguag

SEQ ID NO: 6466 - RNA, 20 nt, Artificial Sequence
  spacer sequence
gccuacuaaguagcugggac

SEQ ID NO: 6467 - RNA, 20 nt, Artificial Sequence
  spacer sequence
cagcuacuuaguaggcugag

SEQ ID NO: 6468 - RNA, 20 nt, Artificial Sequence
  spacer sequence
guagagacaggguuuugcua

SEQ ID NO: 6469 - RNA, 20 nt, Artificial Sequence
  spacer sequence
acugaaaaaauacaaaaauu

SEQ ID NO: 6470 - RNA, 20 nt, Artificial Sequence
  spacer sequence
cuacugaaaaaauacaaaaa

SEQ ID NO: 6471 - RNA, 20 nt, Artificial Sequence
  spacer sequence
caaacuccugaccucagaug

SEQ ID NO: 6472 - RNA, 20 nt, Artificial Sequence
  spacer sequence
aacuccugaccucagaugau

SEQ ID NO: 6473 - RNA, 20 nt, Artificial Sequence
  spacer sequence
ugaccucagaugauccagcc

SEQ ID NO: 6474 - RNA, 20 nt, Artificial Sequence
  spacer sequence
ggaguuugagaccagccugg

SEQ ID NO: 6475 - RNA, 20 nt, Artificial Sequence
  spacer sequence
gaugauccagccaccucagc

SEQ ID NO: 6476 - RNA, 20 nt, Artificial Sequence
  spacer sequence
gaggucaggaguuugagacc

SEQ ID NO: 6477 - RNA, 20 nt, Artificial Sequence
  spacer sequence
ucugaggucaggaguuugag

SEQ ID NO: 6478 - RNA, 20 nt, Artificial Sequence
  spacer sequence
agccaccucagcuucccaaa

SEQ ID NO: 6479 - RNA, 20 nt, Artificial Sequence
  spacer sequence
gcuucccaaagugcuggggu

SEQ ID NO: 6480 - RNA, 20 nt, Artificial Sequence
  spacer sequence
caaagugcugggguuccagg

SEQ ID NO: 6481 - RNA, 20 nt, Artificial Sequence
  spacer sequence
agguguuagccaccaugccu

SEQ ID NO: 6482 - RNA, 20 nt, Artificial Sequence
  spacer sequence
auggccaggcaugguggcua

SEQ ID NO: 6483 - RNA, 20 nt, Artificial Sequence
  spacer sequence
guucccuucucacuguggcu

SEQ ID NO: 6484 - RNA, 20 nt, Artificial Sequence
  spacer sequence
cuucucacuguggcuguacc

SEQ ID NO: 6485 - RNA, 20 nt, Artificial Sequence
  spacer sequence
cacuguggcuguaccaaggu

SEQ ID NO: 6486 - RNA, 20 nt, Artificial Sequence
  spacer sequence
cuguggcuguaccaaggugu

SEQ ID NO: 6487 - RNA, 20 nt, Artificial Sequence
  spacer sequence
cagaagucgugaugcagguc

SEQ ID NO: 6488 - RNA, 20 nt, Artificial Sequence
  spacer sequence
gggauaagcaacaccuuggu

SEQ ID NO: 6489 - RNA, 20 nt, Artificial Sequence
  spacer sequence
ugaugcaggucagcacuuuc

SEQ ID NO: 6490 - RNA, 20 nt, Artificial Sequence
  spacer sequence
cgacuucugggauaagcaac

SEQ ID NO: 6491 - RNA, 20 nt, Artificial Sequence
  spacer sequence
gcacuuucuccaugggaagu

SEQ ID NO: 6492 - RNA, 20 nt, Artificial Sequence
  spacer sequence
ccaugggaaguuuuagcagu

SEQ ID NO: 6493 - RNA, 20 nt, Artificial Sequence
  spacer sequence
augggaaguuuuagcagugu

SEQ ID NO: 6494 - RNA, 20 nt, Artificial Sequence
  spacer sequence
cauggagaaagugcugaccu

SEQ ID NO: 6495 - RNA, 20 nt, Artificial Sequence
  spacer sequence
uuuuagaauguauuugggaa

SEQ ID NO: 6496 - RNA, 20 nt, Artificial Sequence
  spacer sequence
aaaaagaaacacugcuaaaa

SEQ ID NO: 6497 - RNA, 20 nt, Artificial Sequence
  spacer sequence
caaauacauucuaaaaagaa

SEQ ID NO: 6498 - RNA, 20 nt, Artificial Sequence
  spacer sequence
uaauuuagcuuuuuuuucuu

SEQ ID NO: 6499 - RNA, 20 nt, Artificial Sequence
  spacer sequence
ucuucuuauaaauaggcugu

SEQ ID NO: 6500 - RNA, 20 nt, Artificial Sequence
  spacer sequence
ucuuauaaauaggcuguacc

SEQ ID NO: 6501 - RNA, 20 nt, Artificial Sequence
  spacer sequence
uauaaauaggcuguaccagu

SEQ ID NO: 6502 - RNA, 20 nt, Artificial Sequence
  spacer sequence
ucacuuuaauccucuaucca

SEQ ID NO: 6503 - RNA, 20 nt, Artificial Sequence
  spacer sequence
cuuuaauccucuauccagaa

SEQ ID NO: 6504 - RNA, 20 nt, Artificial Sequence
  spacer sequence
ucuauccagaaaacacggug

SEQ ID NO: 6505 - RNA, 20 nt, Artificial Sequence
  spacer sequence
auccagaaaacacggugggc

SEQ ID NO: 6506 - RNA, 20 nt, Artificial Sequence
  spacer sequence
agaaaacacggugggccaaa

SEQ ID NO: 6507 - RNA, 20 nt, Artificial Sequence
  spacer sequence
ggauagaggauuaaagugag

SEQ ID NO: 6508 - RNA, 20 nt, Artificial Sequence
  spacer sequence
uuuggcccaccguguuuucu

SEQ ID NO: 6509 - RNA, 20 nt, Artificial Sequence
  spacer sequence
uccuuuggcccaccguguuu

SEQ ID NO: 6510 - RNA, 20 nt, Artificial Sequence
  spacer sequence
ucauccuuuggcccaccgug

SEQ ID NO: 6511 - RNA, 20 nt, Artificial Sequence
  spacer sequence
cuucauccuuuggcccaccg

SEQ ID NO: 6512 - RNA, 20 nt, Artificial Sequence
  spacer sequence
uguuaccucucuucauccuu

SEQ ID NO: 6513 - RNA, 20 nt, Artificial Sequence
  spacer sequence
uguaauaauggcgauagcuu

SEQ ID NO: 6514 - RNA, 20 nt, Artificial Sequence
  spacer sequence
ccauuauuacaagaguuaag

SEQ ID NO: 6515 - RNA, 20 nt, Artificial Sequence
  spacer sequence
ggaguucauaugguauacua

SEQ ID NO: 6516 - RNA, 20 nt, Artificial Sequence
  spacer sequence
agaaagcuaucgccauuauu

SEQ ID NO: 6517 - RNA, 20 nt, Artificial Sequence
  spacer sequence
uaugguauacuacuuguaaa

SEQ ID NO: 6518 - RNA, 20 nt, Artificial Sequence
  spacer sequence
uagcacauauuuacaaguag

SEQ ID NO: 6519 - RNA, 20 nt, Artificial Sequence
  spacer sequence
guguuucccccaccuuugcu

SEQ ID NO: 6520 - RNA, 20 nt, Artificial Sequence
  spacer sequence
cccaccuuugcuuuugaacu

SEQ ID NO: 6521 - RNA, 20 nt, Artificial Sequence
  spacer sequence
aaagcaaaggugggggaaac

SEQ ID NO: 6522 - RNA, 20 nt, Artificial Sequence
  spacer sequence
gcaaguucaaaagcaaaggu

SEQ ID NO: 6523 - RNA, 20 nt, Artificial Sequence
  spacer sequence
ucuaaaccccugcucccaaa

SEQ ID NO: 6524 - RNA, 20 nt, Artificial Sequence
  spacer sequence
aaaccccugcucccaaaugc

SEQ ID NO: 6525 - RNA, 20 nt, Artificial Sequence
  spacer sequence
caaaugcuggaaugcuuuua

SEQ ID NO: 6526 - RNA, 20 nt, Artificial Sequence
  spacer sequence
agcauuugggagcagggguu

SEQ ID NO: 6527 - RNA, 20 nt, Artificial Sequence
  spacer sequence
ugggcuuaaaggaauugaca

SEQ ID NO: 6528 - RNA, 20 nt, Artificial Sequence
  spacer sequence
uuuaagcccaggaaguaaaa

SEQ ID NO: 6529 - RNA, 20 nt, Artificial Sequence
  spacer sequence
auuccuuuaagcccaggaag

SEQ ID NO: 6530 - RNA, 20 nt, Artificial Sequence
  spacer sequence
ccauuugucaauuccuuuaa

SEQ ID NO: 6531 - RNA, 20 nt, Artificial Sequence
  spacer sequence
uuuuaaguguccccauuugu

SEQ ID NO: 6532 - RNA, 20 nt, Artificial Sequence
  spacer sequence
auaaaugcuacaaaaccaaa

SEQ ID NO: 6533 - RNA, 20 nt, Artificial Sequence
  spacer sequence
auauucaauaaaugcuacaa

SEQ ID NO: 6534 - RNA, 20 nt, Artificial Sequence
  spacer sequence
ccuuuggcacuuguauuagu

SEQ ID NO: 6535 - RNA, 20 nt, Artificial Sequence
  spacer sequence
uguauuaguuccccuuuggc

SEQ ID NO: 6536 - RNA, 20 nt, Artificial Sequence
  spacer sequence
ugaacaguacugucaaccac

SEQ ID NO: 6537 - RNA, 20 nt, Artificial Sequence
  spacer sequence
ugacauuuccuguauuaguu

SEQ ID NO: 6538 - RNA, 20 nt, Artificial Sequence
  spacer sequence
accacuagcaaaaucaauca

SEQ ID NO: 6539 - RNA, 20 nt, Artificial Sequence
  spacer sequence
aucaucauugugaaacauag

SEQ ID NO: 6540 - RNA, 20 nt, Artificial Sequence
  spacer sequence
ucauugugaaacauaggaag

SEQ ID NO: 6541 - RNA, 20 nt, Artificial Sequence
  spacer sequence
uugugaaacauaggaagcuu

SEQ ID NO: 6542 - RNA, 20 nt, Artificial Sequence
  spacer sequence
caaugaugauugauuuugcu

SEQ ID NO: 6543 - RNA, 20 nt, Artificial Sequence
  spacer sequence
uauguuucacaaugaugauu

SEQ ID NO: 6544 - RNA, 20 nt, Artificial Sequence
  spacer sequence
guagauaaaaaaaaaaauug

SEQ ID NO: 6545 - RNA, 20 nt, Artificial Sequence
  spacer sequence
acagaagcuuccuauguuuc

SEQ ID NO: 6546 - RNA, 20 nt, Artificial Sequence
  spacer sequence
auuuuuuuuuuuaucuacag

SEQ ID NO: 6547 - RNA, 20 nt, Artificial Sequence
  spacer sequence
guaucaauuuuuuuuuuuau

SEQ ID NO: 6548 - RNA, 20 nt, Artificial Sequence
  spacer sequence
agacuccauuuauaugugua

SEQ ID NO: 6549 - RNA, 20 nt, Artificial Sequence
  spacer sequence
acuaguuuucaguaucaauu

SEQ ID NO: 6550 - RNA, 20 nt, Artificial Sequence
  spacer sequence
cgacuaguuuucaguaucaa

SEQ ID NO: 6551 - RNA, 20 nt, Artificial Sequence
  spacer sequence
auuuauauguguauguuuuc

SEQ ID NO: 6552 - RNA, 20 nt, Artificial Sequence
  spacer sequence
gaaagccuuucagaaaaaua

SEQ ID NO: 6553 - RNA, 20 nt, Artificial Sequence
  spacer sequence
gaaaacauacacauauaaau

SEQ ID NO: 6554 - RNA, 20 nt, Artificial Sequence
  spacer sequence
gaaaaauauuaaauuuaagg

SEQ ID NO: 6555 - RNA, 20 nt, Artificial Sequence
  spacer sequence
gaaaggcuuucagaaaacau

SEQ ID NO: 6556 - RNA, 20 nt, Artificial Sequence
  spacer sequence
uuaaauuuaauauuuuucug

SEQ ID NO: 6557 - RNA, 20 nt, Artificial Sequence
  spacer sequence
uguccuuaaauuuaauauuu

SEQ ID NO: 6558 - RNA, 20 nt, Artificial Sequence
  spacer sequence
gaggccuugggacauagcuu

SEQ ID NO: 6559 - RNA, 20 nt, Artificial Sequence
  spacer sequence
gauauaaaaaucuuguccuu

SEQ ID NO: 6560 - RNA, 20 nt, Artificial Sequence
  spacer sequence
caaggccucugauauaaaaa

SEQ ID NO: 6561 - RNA, 20 nt, Artificial Sequence
  spacer sequence
guaacugagaguuuacccuu

SEQ ID NO: 6562 - RNA, 20 nt, Artificial Sequence
  spacer sequence
guuacugaguuaugccuguu

SEQ ID NO: 6563 - RNA, 20 nt, Artificial Sequence
  spacer sequence
caguuacugaguuaugccug

SEQ ID NO: 6564 - RNA, 20 nt, Artificial Sequence
  spacer sequence
gaaaucaggugcagccccau

SEQ ID NO: 6565 - RNA, 20 nt, Artificial Sequence
  spacer sequence
gaaguaccaaaggguaaacu

SEQ ID NO: 6566 - RNA, 20 nt, Artificial Sequence
  spacer sequence
ggugcagccccaucuuucuu

SEQ ID NO: 6567 - RNA, 20 nt, Artificial Sequence
  spacer sequence
uucuucccagagcauuagug

SEQ ID NO: 6568 - RNA, 20 nt, Artificial Sequence
  spacer sequence
ucccagagcauuagugugua

SEQ ID NO: 6569 - RNA, 20 nt, Artificial Sequence
  spacer sequence
cagagcauuaguguguagac

SEQ ID NO: 6570 - RNA, 20 nt, Artificial Sequence
  spacer sequence
gggaagaaagauggggcugc

SEQ ID NO: 6571 - RNA, 20 nt, Artificial Sequence
  spacer sequence
acacacuaaugcucugggaa

SEQ ID NO: 6572 - RNA, 20 nt, Artificial Sequence
  spacer sequence
cgucuacacacuaaugcucu

SEQ ID NO: 6573 - RNA, 20 nt, Artificial Sequence
  spacer sequence
aacaaggcuucacgucuaca

SEQ ID NO: 6574 - RNA, 20 nt, Artificial Sequence
  spacer sequence
ucaaacaaggcuucacgucu

SEQ ID NO: 6575 - RNA, 20 nt, Artificial Sequence
  spacer sequence
aaauacagcucuucaaacaa

SEQ ID NO: 6576 - RNA, 20 nt, Artificial Sequence
  spacer sequence
acucagucaaguuuuaauuu

SEQ ID NO: 6577 - RNA, 20 nt, Artificial Sequence
  spacer sequence
gucaaguuuuaauuuagcuc

SEQ ID NO: 6578 - RNA, 20 nt, Artificial Sequence
  spacer sequence
aguuuuaauuuagcucauga

SEQ ID NO: 6579 - RNA, 20 nt, Artificial Sequence
  spacer sequence
ugaacuaccuugauguuuag

SEQ ID NO: 6580 - RNA, 20 nt, Artificial Sequence
  spacer sequence
ugagcuaaauuaaaacuuga

SEQ ID NO: 6581 - RNA, 20 nt, Artificial Sequence
  spacer sequence
agguaguucaugagcuaaau

SEQ ID NO: 6582 - RNA, 20 nt, Artificial Sequence
  spacer sequence
gcccuaauccaucugaugcu

SEQ ID NO: 6583 - RNA, 20 nt, Artificial Sequence
  spacer sequence
aucugaugcuuuuucauuau

SEQ ID NO: 6584 - RNA, 20 nt, Artificial Sequence
  spacer sequence
gaugcuuuuucauuauuagg

SEQ ID NO: 6585 - RNA, 20 nt, Artificial Sequence
  spacer sequence
gauggauuagggcugaugcc

SEQ ID NO: 6586 - RNA, 20 nt, Artificial Sequence
  spacer sequence
uuauuaggcauguuggagac

SEQ ID NO: 6587 - RNA, 20 nt, Artificial Sequence
  spacer sequence
aacaugccuaauaaugaaaa

SEQ ID NO: 6588 - RNA, 20 nt, Artificial Sequence
  spacer sequence
ccaacaugccuaauaaugaa

SEQ ID NO: 6589 - RNA, 20 nt, Artificial Sequence
  spacer sequence
cauugcccaagucuccaaca

SEQ ID NO: 6590 - RNA, 20 nt, Artificial Sequence
  spacer sequence
gcagucacauugcccaaguc

SEQ ID NO: 6591 - RNA, 20 nt, Artificial Sequence
  spacer sequence
uugucagcagucacauugcc

SEQ ID NO: 6592 - RNA, 20 nt, Artificial Sequence
  spacer sequence
gccacaccaucuuugucagc

SEQ ID NO: 6593 - RNA, 20 nt, Artificial Sequence
  spacer sequence
auugaagauucugugaucuc

SEQ ID NO: 6594 - RNA, 20 nt, Artificial Sequence
  spacer sequence
auagacacaucggccacacc

SEQ ID NO: 6595 - RNA, 20 nt, Artificial Sequence
  spacer sequence
ucaauagacacaucggccac

SEQ ID NO: 6596 - RNA, 20 nt, Artificial Sequence
  spacer sequence
gugaucucacucucaggaga

SEQ ID NO: 6597 - RNA, 20 nt, Artificial Sequence
  spacer sequence
cagaaucuucaauagacaca

SEQ ID NO: 6598 - RNA, 20 nt, Artificial Sequence
  spacer sequence
cacucucaggagaccauugc

SEQ ID NO: 6599 - RNA, 20 nt, Artificial Sequence
  spacer sequence
cucucaggagaccauugcau

SEQ ID NO: 6600 - RNA, 20 nt, Artificial Sequence
  spacer sequence
caggagaccauugcaucauu

SEQ ID NO: 6601 - RNA, 20 nt, Artificial Sequence
  spacer sequence
ggagaccauugcaucauugg

SEQ ID NO: 6602 - RNA, 20 nt, Artificial Sequence
  spacer sequence
ugagagugagaucacagaau

SEQ ID NO: 6603 - RNA, 20 nt, Artificial Sequence
  spacer sequence
ccugagagugagaucacaga

SEQ ID NO: 6604 - RNA, 20 nt, Artificial Sequence
  spacer sequence
uuggccgcacacugguggua

SEQ ID NO: 6605 - RNA, 20 nt, Artificial Sequence
  spacer sequence
uaaaaggauaugcauaaaac

SEQ ID NO: 6606 - RNA, 20 nt, Artificial Sequence
  spacer sequence
uuuuaugaaaacuuaccacc

SEQ ID NO: 6607 - RNA, 20 nt, Artificial Sequence
  spacer sequence
ucuaacauacagucauguau

SEQ ID NO: 6608 - RNA, 20 nt, Artificial Sequence
  spacer sequence
aacauacagucauguaucuu

SEQ ID NO: 6609 - RNA, 20 nt, Artificial Sequence
  spacer sequence
uguaucuuuucacuuugauu

SEQ ID NO: 6610 - RNA, 20 nt, Artificial Sequence
  spacer sequence
uuucacuuugauuguuaguc

SEQ ID NO: 6611 - RNA, 20 nt, Artificial Sequence
  spacer sequence
cuuugauuguuagucgcggu

SEQ ID NO: 6612 - RNA, 20 nt, Artificial Sequence
  spacer sequence
aagugaaaagauacaugacu

SEQ ID NO: 6613 - RNA, 20 nt, Artificial Sequence
  spacer sequence
cgguuucuaaagauccagau

SEQ ID NO: 6614 - RNA, 20 nt, Artificial Sequence
  spacer sequence
aaagauccagauaaacugua

SEQ ID NO: 6615 - RNA, 20 nt, Artificial Sequence
  spacer sequence
uuagaaaccgcgacuaacaa

SEQ ID NO: 6616 - RNA, 20 nt, Artificial Sequence
  spacer sequence
agauaaacuguacuugcagu

SEQ ID NO: 6617 - RNA, 20 nt, Artificial Sequence
  spacer sequence
ggaucuuuagaaaccgcgac

SEQ ID NO: 6618 - RNA, 20 nt, Artificial Sequence
  spacer sequence
aauuaggaaaagcaauuuua

SEQ ID NO: 6619 - RNA, 20 nt, Artificial Sequence
  spacer sequence
uaauuugaacugcaaguaca

SEQ ID NO: 6620 - RNA, 20 nt, Artificial Sequence
  spacer sequence
aauaaaauugcuuuuccuaa

SEQ ID NO: 6621 - RNA, 20 nt, Artificial Sequence
  spacer sequence
ccguaauuguccaauaaaau

SEQ ID NO: 6622 - RNA, 20 nt, Artificial Sequence
  spacer sequence
uuuucaccguaauuguccaa

SEQ ID NO: 6623 - RNA, 20 nt, Artificial Sequence
  spacer sequence
aggucaguuaagaacacugu

SEQ ID NO: 6624 - RNA, 20 nt, Artificial Sequence
  spacer sequence
guuaagaacacuguucugcu

SEQ ID NO: 6625 - RNA, 20 nt, Artificial Sequence
  spacer sequence
uaacugaccuagauaaaaua

SEQ ID NO: 6626 - RNA, 20 nt, Artificial Sequence
  spacer sequence
gcuaagaugcaguaaaaagc

SEQ ID NO: 6627 - RNA, 20 nt, Artificial Sequence
  spacer sequence
uagcagaacaguguucuuaa

SEQ ID NO: 6628 - RNA, 20 nt, Artificial Sequence
  spacer sequence
aauguaaccugcuuuuuacu

SEQ ID NO: 6629 - RNA, 20 nt, Artificial Sequence
  spacer sequence
aauauggucaaauguaaccu

SEQ ID NO: 6630 - RNA, 20 nt, Artificial Sequence
  spacer sequence
gaguuuggaaaacagaagua

SEQ ID NO: 6631 - RNA, 20 nt, Artificial Sequence
  spacer sequence
gaucuaauauggucaaaugu

SEQ ID NO: 6632 - RNA, 20 nt, Artificial Sequence
  spacer sequence
aaacucagaucuaauauggu

SEQ ID NO: 6633 - RNA, 20 nt, Artificial Sequence
  spacer sequence
guuuuccaaacucagaucua

SEQ ID NO: 6634 - RNA, 20 nt, Artificial Sequence
  spacer sequence
uuaguuuuaaaauggccaga

SEQ ID NO: 6635 - RNA, 20 nt, Artificial Sequence
  spacer sequence
ggccauuuuaaaacuaaaga

SEQ ID NO: 6636 - RNA, 20 nt, Artificial Sequence
  spacer sequence
ugccaggauuggguuucuca

SEQ ID NO: 6637 - RNA, 20 nt, Artificial Sequence
  spacer sequence
uggcaagaaaaucuggccau

SEQ ID NO: 6638 - RNA, 20 nt, Artificial Sequence
  spacer sequence
cacuuguuaaacagaacauu

SEQ ID NO: 6639 - RNA, 20 nt, Artificial Sequence
  spacer sequence
cuuguuaaacagaacauuuu

SEQ ID NO: 6640 - RNA, 20 nt, Artificial Sequence
  spacer sequence
guuuaacaagugagaaaccc

SEQ ID NO: 6641 - RNA, 20 nt, Artificial Sequence
  spacer sequence
cagguuuuaaacuuaacaaa

SEQ ID NO: 6642 - RNA, 20 nt, Artificial Sequence
  spacer sequence
aucccagguuuuaaacuuaa

SEQ ID NO: 6643 - RNA, 20 nt, Artificial Sequence
  spacer sequence
uguucauucauguucauuca

SEQ ID NO: 6644 - RNA, 20 nt, Artificial Sequence
  spacer sequence
uucauguucauucaggacug

SEQ ID NO: 6645 - RNA, 20 nt, Artificial Sequence
  spacer sequence
uguucauucaggacugcagg

SEQ ID NO: 6646 - RNA, 20 nt, Artificial Sequence
  spacer sequence
uucaggacugcagguuauca

SEQ ID NO: 6647 - RNA, 20 nt, Artificial Sequence
  spacer sequence
ggacugcagguuaucaugac

SEQ ID NO: 6648 - RNA, 20 nt, Artificial Sequence
  spacer sequence
ugaaugaacaugaaugaaca

SEQ ID NO: 6649 - RNA, 20 nt, Artificial Sequence
  spacer sequence
ugacuuguuuaacuuguggg

SEQ ID NO: 6650 - RNA, 20 nt, Artificial Sequence
  spacer sequence
ugauaaccugcaguccugaa

SEQ ID NO: 6651 - RNA, 20 nt, Artificial Sequence
  spacer sequence
cacaaguuaaacaagucaug

SEQ ID NO: 6652 - RNA, 20 nt, Artificial Sequence
  spacer sequence
caaguuauccuggggaacug

SEQ ID NO: 6653 - RNA, 20 nt, Artificial Sequence
  spacer sequence
uggggaacugcaucugguuc

SEQ ID NO: 6654 - RNA, 20 nt, Artificial Sequence
  spacer sequence
ccaggauaacuugggacaac

SEQ ID NO: 6655 - RNA, 20 nt, Artificial Sequence
  spacer sequence
gguucuugcaaaacaccaag

SEQ ID NO: 6656 - RNA, 20 nt, Artificial Sequence
  spacer sequence
ugcaaaacaccaaguagaca

SEQ ID NO: 6657 - RNA, 20 nt, Artificial Sequence
  spacer sequence
acuugguguuuugcaagaac

SEQ ID NO: 6658 - RNA, 20 nt, Artificial Sequence
  spacer sequence
cuuuuaccuccccuugaggg

SEQ ID NO: 6659 - RNA, 20 nt, Artificial Sequence
  spacer sequence
uuuaccuccccuugagggca

SEQ ID NO: 6660 - RNA, 20 nt, Artificial Sequence
  spacer sequence
ccuugagggcauuaacauuc

SEQ ID NO: 6661 - RNA, 20 nt, Artificial Sequence
  spacer sequence
aggggagguaaaagagagcc

SEQ ID NO: 6662 - RNA, 20 nt, Artificial Sequence
  spacer sequence
guagucacuuccauucaguu

SEQ ID NO: 6663 - RNA, 20 nt, Artificial Sequence
  spacer sequence
cuuccauucaguuaacccuu

SEQ ID NO: 6664 - RNA, 20 nt, Artificial Sequence
  spacer sequence
auucaguuaacccuuuauuu

SEQ ID NO: 6665 - RNA, 20 nt, Artificial Sequence
  spacer sequence
guuaacccuuuauuuuuaug

SEQ ID NO: 6666 - RNA, 20 nt, Artificial Sequence
  spacer sequence
ugagccauaguuguaaagca

SEQ ID NO: 6667 - RNA, 20 nt, Artificial Sequence
  spacer sequence
agaaaaaccauaaaaauaaa

SEQ ID NO: 6668 - RNA, 20 nt, Artificial Sequence
  spacer sequence
gcuuuacaacuauggcucaa

SEQ ID NO: 6669 - RNA, 20 nt, Artificial Sequence
  spacer sequence
uuuauaaagguuuguugaac

SEQ ID NO: 6670 - RNA, 20 nt, Artificial Sequence
  spacer sequence
acaaaccuuuauaaaugauu

SEQ ID NO: 6671 - RNA, 20 nt, Artificial Sequence
  spacer sequence
aaauacuguugcuuaaagua

SEQ ID NO: 6672 - RNA, 20 nt, Artificial Sequence
  spacer sequence
uaauacuuuaagcaacagua

SEQ ID NO: 6673 - RNA, 20 nt, Artificial Sequence
  spacer sequence
uaaaaaaucuuaauacuuua

SEQ ID NO: 6674 - RNA, 20 nt, Artificial Sequence
  spacer sequence
uucauuuggcaugaaauuuu

SEQ ID NO: 6675 - RNA, 20 nt, Artificial Sequence
  spacer sequence
uuuggcaugaaauuuugagu

SEQ ID NO: 6676 - RNA, 20 nt, Artificial Sequence
  spacer sequence
ugccaaaugaaugacgggcc

SEQ ID NO: 6677 - RNA, 20 nt, Artificial Sequence
  spacer sequence
aaauuucaugccaaaugaau

SEQ ID NO: 6678 - RNA, 20 nt, Artificial Sequence
  spacer sequence
cuuucacuuuccuuuuuuuc

SEQ ID NO: 6679 - RNA, 20 nt, Artificial Sequence
  spacer sequence
cuuuccuuuuuuuccaaagc

SEQ ID NO: 6680 - RNA, 20 nt, Artificial Sequence
  spacer sequence
uuuuuuuccaaagcaauuaa

SEQ ID NO: 6681 - RNA, 20 nt, Artificial Sequence
  spacer sequence
aaagcaauuaaaaaaacugc

SEQ ID NO: 6682 - RNA, 20 nt, Artificial Sequence
  spacer sequence
uacuuuggcaguuuuuuuaa

SEQ ID NO: 6683 - RNA, 20 nt, Artificial Sequence
  spacer sequence
cucuuacuuuggcaguuuuu

SEQ ID NO: 6684 - RNA, 20 nt, Artificial Sequence
  spacer sequence
gcagucacucuuacuuuggc

SEQ ID NO: 6685 - RNA, 20 nt, Artificial Sequence
  spacer sequence
augguaaguuacaguaaccu

SEQ ID NO: 6686 - RNA, 20 nt, Artificial Sequence
  spacer sequence
uccaugguaaguuacaguaa

SEQ ID NO: 6687 - RNA, 20 nt, Artificial Sequence
  spacer sequence
acaacauaguuauuuggguu

SEQ ID NO: 6688 - RNA, 20 nt, Artificial Sequence
  spacer sequence
uuuagacagcaacacuuacc

SEQ ID NO: 6689 - RNA, 20 nt, Artificial Sequence
  spacer sequence
aaaugaaauacuaaaaccca

SEQ ID NO: 6690 - RNA, 20 nt, Artificial Sequence
  spacer sequence
uugcaacaccaagaaaaagc

SEQ ID NO: 6691 - RNA, 20 nt, Artificial Sequence
  spacer sequence
ugguguugcaaagacauuac

SEQ ID NO: 6692 - RNA, 20 nt, Artificial Sequence
  spacer sequence
aagcuuuuucuugguguugc

SEQ ID NO: 6693 - RNA, 20 nt, Artificial Sequence
  spacer sequence
acuuuuaaacuacuaaauau

SEQ ID NO: 6694 - RNA, 20 nt, Artificial Sequence
  spacer sequence
cucuacuaggauuaauguua

SEQ ID NO: 6695 - RNA, 20 nt, Artificial Sequence
  spacer sequence
cuacuaggauuaauguuauu

SEQ ID NO: 6696 - RNA, 20 nt, Artificial Sequence
  spacer sequence
acuaggauuaauguuauuuu

SEQ ID NO: 6697 - RNA, 20 nt, Artificial Sequence
  spacer sequence
uaguagagagauauacuaau

SEQ ID NO: 6698 - RNA, 20 nt, Artificial Sequence
  spacer sequence
aauauuaugagguucuuaaa

SEQ ID NO: 6699 - RNA, 20 nt, Artificial Sequence
  spacer sequence
uaauauuagaaaaauaacau

SEQ ID NO: 6700 - RNA, 20 nt, Artificial Sequence
  spacer sequence
uaaacaucuuuuggguauug

SEQ ID NO: 6701 - RNA, 20 nt, Artificial Sequence
  spacer sequence
uuuggguauuguugggagga

SEQ ID NO: 6702 - RNA, 20 nt, Artificial Sequence
  spacer sequence
caacaauacccaaaagaugu

SEQ ID NO: 6703 - RNA, 20 nt, Artificial Sequence
  spacer sequence
ucccaacaauacccaaaaga

SEQ ID NO: 6704 - RNA, 20 nt, Artificial Sequence
  spacer sequence
cuaccuccucccaacaauac

SEQ ID NO: 6705 - RNA, 20 nt, Artificial Sequence
  spacer sequence
aguaaucacuaccuccuccc

SEQ ID NO: 6706 - RNA, 20 nt, Artificial Sequence
  spacer sequence
ucuuaaaauuuuuuacaggu

SEQ ID NO: 6707 - RNA, 20 nt, Artificial Sequence
  spacer sequence
uaaaauuuuuuacaggucca

SEQ ID NO: 6708 - RNA, 20 nt, Artificial Sequence
  spacer sequence
augaaaaagcagaugacuug

SEQ ID NO: 6709 - RNA, 20 nt, Artificial Sequence
  spacer sequence
uggaccuguaaaaaauuuua

SEQ ID NO: 6710 - RNA, 20 nt, Artificial Sequence
  spacer sequence
gcuuuuucauggaccuguaa

SEQ ID NO: 6711 - RNA, 20 nt, Artificial Sequence
  spacer sequence
ucugcuuuuucauggaccug

SEQ ID NO: 6712 - RNA, 20 nt, Artificial Sequence
  spacer sequence
accuuugcccaagucaucug

SEQ ID NO: 6713 - RNA, 20 nt, Artificial Sequence
  spacer sequence
uuuccaccuuugcccaaguc

SEQ ID NO: 6714 - RNA, 20 nt, Artificial Sequence
  spacer sequence
ucauuuccaccuuugcccaa

SEQ ID NO: 6715 - RNA, 20 nt, Artificial Sequence
  spacer sequence
uuguacuuucuucauuucca

SEQ ID NO: 6716 - RNA, 20 nt, Artificial Sequence
  spacer sequence
ugucuuuguacuuucuucau

SEQ ID NO: 6717 - RNA, 20 nt, Artificial Sequence
  spacer sequence
agcguuuccugucuuuguac

SEQ ID NO: 6718 - RNA, 20 nt, Artificial Sequence
  spacer sequence
uuuggcuugugguguaauug

SEQ ID NO: 6719 - RNA, 20 nt, Artificial Sequence
  spacer sequence
caauuacaccacaagccaaa

SEQ ID NO: 6720 - RNA, 20 nt, Artificial Sequence
  spacer sequence
cccaauaaacauucccuugg

SEQ ID NO: 6721 - RNA, 20 nt, Artificial Sequence
  spacer sequence
cuuggauguagucugaggcc

SEQ ID NO: 6722 - RNA, 20 nt, Artificial Sequence
  spacer sequence
aagggaauguuuauugggcg

SEQ ID NO: 6723 - RNA, 20 nt, Artificial Sequence
  spacer sequence
gaggccccuuaacucaucug

SEQ ID NO: 6724 - RNA, 20 nt, Artificial Sequence
  spacer sequence
gacuacauccaagggaaugu

SEQ ID NO: 6725 - RNA, 20 nt, Artificial Sequence
  spacer sequence
ucuguuauccugcuagcugu

SEQ ID NO: 6726 - RNA, 20 nt, Artificial Sequence
  spacer sequence
guuauccugcuagcuguaga

SEQ ID NO: 6727 - RNA, 20 nt, Artificial Sequence
  spacer sequence
ugcuagcuguagaaauguau

SEQ ID NO: 6728 - RNA, 20 nt, Artificial Sequence
  spacer sequence
acagcuagcaggauaacaga

SEQ ID NO: 6729 - RNA, 20 nt, Artificial Sequence
  spacer sequence
ugauaaacauuaaacacugu

SEQ ID NO: 6730 - RNA, 20 nt, Artificial Sequence
  spacer sequence
ggauacauuucuacagcuag

SEQ ID NO: 6731 - RNA, 20 nt, Artificial Sequence
  spacer sequence
uaaaaguguaauugugugac

SEQ ID NO: 6732 - RNA, 20 nt, Artificial Sequence
  spacer sequence
cacaauuacacuuuuaagau

SEQ ID NO: 6733 - RNA, 20 nt, Artificial Sequence
  spacer sequence
gaguugcuuuaaaguaccug

SEQ ID NO: 6734 - RNA, 20 nt, Artificial Sequence
  spacer sequence
gaaaaagucacacaauuaca

SEQ ID NO: 6735 - RNA, 20 nt, Artificial Sequence
  spacer sequence
cuacagguacuuuaaagcaa

SEQ ID NO: 6736 - RNA, 20 nt, Artificial Sequence
  spacer sequence
cacuacagguacuuuaaagc

SEQ ID NO: 6737 - RNA, 20 nt, Artificial Sequence
  spacer sequence
guuucucacuacagguacuu

SEQ ID NO: 6738 - RNA, 20 nt, Artificial Sequence
  spacer sequence
uaaaucaguuucucacuaca

SEQ ID NO: 6739 - RNA, 20 nt, Artificial Sequence
  spacer sequence
cuuggaagauuuguauaguu

SEQ ID NO: 6740 - RNA, 20 nt, Artificial Sequence
  spacer sequence
aagugaucauaaaucaguuu

SEQ ID NO: 6741 - RNA, 20 nt, Artificial Sequence
  spacer sequence
uccaagugaucauaaaucag

SEQ ID NO: 6742 - RNA, 20 nt, Artificial Sequence
  spacer sequence
guuaaaaugucuguuucaau

SEQ ID NO: 6743 - RNA, 20 nt, Artificial Sequence
  spacer sequence
guuucaaugaccuguauuuu

SEQ ID NO: 6744 - RNA, 20 nt, Artificial Sequence
  spacer sequence
augaccuguauuuugccaga

SEQ ID NO: 6745 - RNA, 20 nt, Artificial Sequence
  spacer sequence
uugaaacagacauuuuaacu

SEQ ID NO: 6746 - RNA, 20 nt, Artificial Sequence
  spacer sequence
ggcaaaauacaggucauuga

SEQ ID NO: 6747 - RNA, 20 nt, Artificial Sequence
  spacer sequence
cagauggguauuaaacuugu

SEQ ID NO: 6748 - RNA, 20 nt, Artificial Sequence
  spacer sequence
gugauuuaagucuggcaaaa

SEQ ID NO: 6749 - RNA, 20 nt, Artificial Sequence
  spacer sequence
gaauuucuuugucauucaag

SEQ ID NO: 6750 - RNA, 20 nt, Artificial Sequence
  spacer sequence
gacaaguuuaauacccaucu

SEQ ID NO: 6751 - RNA, 20 nt, Artificial Sequence
  spacer sequence
uugucauucaagccugugaa

SEQ ID NO: 6752 - RNA, 20 nt, Artificial Sequence
  spacer sequence
uucaagccugugaauaaaaa

SEQ ID NO: 6753 - RNA, 20 nt, Artificial Sequence
  spacer sequence
agccugugaauaaaaacccu

SEQ ID NO: 6754 - RNA, 20 nt, Artificial Sequence
  spacer sequence
caggcuugaaugacaaagaa

SEQ ID NO: 6755 - RNA, 20 nt, Artificial Sequence
  spacer sequence
uaauaagugccauacagggu

SEQ ID NO: 6756 - RNA, 20 nt, Artificial Sequence
  spacer sequence
uuuaauagccucauaauaag

SEQ ID NO: 6757 - RNA, 20 nt, Artificial Sequence
  spacer sequence
aaauucaaacuaaauuagcu

SEQ ID NO: 6758 - RNA, 20 nt, Artificial Sequence
  spacer sequence
aacuaaauuagcucugauac

SEQ ID NO: 6759 - RNA, 20 nt, Artificial Sequence
  spacer sequence
gauacuuauuuauauaaaca

SEQ ID NO: 6760 - RNA, 20 nt, Artificial Sequence
  spacer sequence
gagcuaauuuaguuugaauu

SEQ ID NO: 6761 - RNA, 20 nt, Artificial Sequence
  spacer sequence
guggaacagauuuaguaaua

SEQ ID NO: 6762 - RNA, 20 nt, Artificial Sequence
  spacer sequence
acugaagcuguuuauauaaa

SEQ ID NO: 6763 - RNA, 20 nt, Artificial Sequence
  spacer sequence
guuccacugaagcuguuuau

SEQ ID NO: 6764 - RNA, 20 nt, Artificial Sequence
  spacer sequence
cuguuaguauuacuaaaucu

SEQ ID NO: 6765 - RNA, 20 nt, Artificial Sequence
  spacer sequence
aaauaaaaugcuaucacugu

SEQ ID NO: 6766 - RNA, 20 nt, Artificial Sequence
  spacer sequence
aaacacuuucaaaauaaaau

SEQ ID NO: 6767 - RNA, 20 nt, Artificial Sequence
  spacer sequence
caaaacacuuucaaaauaaa

SEQ ID NO: 6768 - RNA, 20 nt, Artificial Sequence
  spacer sequence
aaaugcauacuuuaaaacag

SEQ ID NO: 6769 - RNA, 20 nt, Artificial Sequence
  spacer sequence
uuuagcuaaaacuaacacaa

SEQ ID NO: 6770 - RNA, 20 nt, Artificial Sequence
  spacer sequence
gcuuagacaaauaggcuguc

SEQ ID NO: 6771 - RNA, 20 nt, Artificial Sequence
  spacer sequence
aagcagaguuguguuaguuu

SEQ ID NO: 6772 - RNA, 20 nt, Artificial Sequence
  spacer sequence
uuugaaagcuuuagggaaau

SEQ ID NO: 6773 - RNA, 20 nt, Artificial Sequence
  spacer sequence
aaggacagccuauuugucua

SEQ ID NO: 6774 - RNA, 20 nt, Artificial Sequence
  spacer sequence
cuaaagcuuucaaaggacag

SEQ ID NO: 6775 - RNA, 20 nt, Artificial Sequence
  spacer sequence
ugcuuagucauuuuagcauu

SEQ ID NO: 6776 - RNA, 20 nt, Artificial Sequence
  spacer sequence
uuuuagcauuuugauucaua

SEQ ID NO: 6777 - RNA, 20 nt, Artificial Sequence
  spacer sequence
aaaugcuaaaaugacuaagc

SEQ ID NO: 6778 - RNA, 20 nt, Artificial Sequence
  spacer sequence
uaaaguaccuccucauuuua

SEQ ID NO: 6779 - RNA, 20 nt, Artificial Sequence
  spacer sequence
ucauuuuaaaaagacauuau

SEQ ID NO: 6780 - RNA, 20 nt, Artificial Sequence
  spacer sequence
uuuuaaaaagacauuaugau

SEQ ID NO: 6781 - RNA, 20 nt, Artificial Sequence
  spacer sequence
uuuuaaaaugaggagguacu

SEQ ID NO: 6782 - RNA, 20 nt, Artificial Sequence
  spacer sequence
uaaugucuuuuuaaaaugag

SEQ ID NO: 6783 - RNA, 20 nt, Artificial Sequence
  spacer sequence
uacaucauaaugucuuuuua

SEQ ID NO: 6784 - RNA, 20 nt, Artificial Sequence
  spacer sequence
cuuacaucauaaugucuuuu

SEQ ID NO: 6785 - RNA, 20 nt, Artificial Sequence
  spacer sequence
aauggcucucuuacaucaua

SEQ ID NO: 6786 - RNA, 20 nt, Artificial Sequence
  spacer sequence
cuaaaaaguuaucaaauggc

SEQ ID NO: 6787 - RNA, 20 nt, Artificial Sequence
  spacer sequence
aagcucacuaaaaaguuauc

SEQ ID NO: 6788 - RNA, 20 nt, Artificial Sequence
  spacer sequence
gcuagcuaguaagauuaucu

SEQ ID NO: 6789 - RNA, 20 nt, Artificial Sequence
  spacer sequence
uacuagcuagcugaggcugu

SEQ ID NO: 6790 - RNA, 20 nt, Artificial Sequence
  spacer sequence
accugccagaauggcacaaa

SEQ ID NO: 6791 - RNA, 20 nt, Artificial Sequence
  spacer sequence
ggcagguagauaaucuuacu

SEQ ID NO: 6792 - RNA, 20 nt, Artificial Sequence
  spacer sequence
acauucaaggguagacgcug

SEQ ID NO: 6793 - RNA, 20 nt, Artificial Sequence
  spacer sequence
aggguagacgcuggcacaac

SEQ ID NO: 6794 - RNA, 20 nt, Artificial Sequence
  spacer sequence
acccuugaauguagaauuug

SEQ ID NO: 6795 - RNA, 20 nt, Artificial Sequence
  spacer sequence
guaaguagguugugccagcg

SEQ ID NO: 6796 - RNA, 20 nt, Artificial Sequence
  spacer sequence
guagcauuagaagauggaac

SEQ ID NO: 6797 - RNA, 20 nt, Artificial Sequence
  spacer sequence
aaugcuacagauugcuuuaa

SEQ ID NO: 6798 - RNA, 20 nt, Artificial Sequence
  spacer sequence
ucuaaugcuacagauugcuu

SEQ ID NO: 6799 - RNA, 20 nt, Artificial Sequence
  spacer sequence
aucuucuaaugcuacagauu

SEQ ID NO: 6800 - RNA, 20 nt, Artificial Sequence
  spacer sequence
uugguuccaucuucuaaugc

SEQ ID NO: 6801 - RNA, 20 nt, Artificial Sequence
  spacer sequence
aacauuuccuugguuccauc

SEQ ID NO: 6802 - RNA, 20 nt, Artificial Sequence
  spacer sequence
ggcuguugagaaauaauuua

SEQ ID NO: 6803 - RNA, 20 nt, Artificial Sequence
  spacer sequence
acagccagaacccacaguca

SEQ ID NO: 6804 - RNA, 20 nt, Artificial Sequence
  spacer sequence
caacagccagaacccacagu

SEQ ID NO: 6805 - RNA, 20 nt, Artificial Sequence
  spacer sequence
guguguaaauuauuucucaa

SEQ ID NO: 6806 - RNA, 20 nt, Artificial Sequence
  spacer sequence
cuaauucgguguguaaauua

SEQ ID NO: 6807 - RNA, 20 nt, Artificial Sequence
  spacer sequence
uuucacuaauucggugugua

SEQ ID NO: 6808 - RNA, 20 nt, Artificial Sequence
  spacer sequence
cuuucucuuaauguauuuau

SEQ ID NO: 6809 - RNA, 20 nt, Artificial Sequence
  spacer sequence
cuuaauguauuuauguaccu

SEQ ID NO: 6810 - RNA, 20 nt, Artificial Sequence
  spacer sequence
uaauguauuuauguaccuga

SEQ ID NO: 6811 - RNA, 20 nt, Artificial Sequence
  spacer sequence
gguacauaaauacauuaaga

SEQ ID NO: 6812 - RNA, 20 nt, Artificial Sequence
  spacer sequence
cagguacauaaauacauuaa

SEQ ID NO: 6813 - RNA, 20 nt, Artificial Sequence
  spacer sequence
cucagguacauaaauacauu

SEQ ID NO: 6814 - RNA, 20 nt, Artificial Sequence
  spacer sequence
auguuaaccuaacucagguu

SEQ ID NO: 6815 - RNA, 20 nt, Artificial Sequence
  spacer sequence
gguuugacuaaauuauucaa

SEQ ID NO: 6816 - RNA, 20 nt, Artificial Sequence
  spacer sequence
aaccugaguuagguuaacau

SEQ ID NO: 6817 - RNA, 20 nt, Artificial Sequence
  spacer sequence
auuggaaauuguagaauauu

SEQ ID NO: 6818 - RNA, 20 nt, Artificial Sequence
  spacer sequence
aauugaauaauuuagucaaa

SEQ ID NO: 6819 - RNA, 20 nt, Artificial Sequence
  spacer sequence
acaauuuccaauugaauaau

SEQ ID NO: 6820 - RNA, 20 nt, Artificial Sequence
  spacer sequence
gauaaaccagaaauaaguga

SEQ ID NO: 6821 - RNA, 20 nt, Artificial Sequence
  spacer sequence
gaaauaauauucuacaauuu

SEQ ID NO: 6822 - RNA, 20 nt, Artificial Sequence
  spacer sequence
gguuuaucagaaauaauauu

SEQ ID NO: 6823 - RNA, 20 nt, Artificial Sequence
  spacer sequence
cuuauuucugguuuaucaga

SEQ ID NO: 6824 - RNA, 20 nt, Artificial Sequence
  spacer sequence
uaaauauguacuuuaucaaa

SEQ ID NO: 6825 - RNA, 20 nt, Artificial Sequence
  spacer sequence
aauguaggagagaucauuua

SEQ ID NO: 6826 - RNA, 20 nt, Artificial Sequence
  spacer sequence
uacauuugauaaaguacaua

SEQ ID NO: 6827 - RNA, 20 nt, Artificial Sequence
  spacer sequence
ccuacauuugauaaaguaca

SEQ ID NO: 6828 - RNA, 20 nt, Artificial Sequence
  spacer sequence
cuccuacauuugauaaagua

SEQ ID NO: 6829 - RNA, 20 nt, Artificial Sequence
  spacer sequence
uuuaggagaggaaaagcuaa

SEQ ID NO: 6830 - RNA, 20 nt, Artificial Sequence
  spacer sequence
uaaaugaucucuccuacauu

SEQ ID NO: 6831 - RNA, 20 nt, Artificial Sequence
  spacer sequence
ccuaaaugaucucuccuaca

SEQ ID NO: 6832 - RNA, 20 nt, Artificial Sequence
  spacer sequence
ucuccuaaaugaucucuccu

SEQ ID NO: 6833 - RNA, 20 nt, Artificial Sequence
  spacer sequence
aauuuagcuuuuccucuccu

SEQ ID NO: 6834 - RNA, 20 nt, Artificial Sequence
  spacer sequence
uccaauuuagcuuuuccucu

SEQ ID NO: 6835 - RNA, 20 nt, Artificial Sequence
  spacer sequence
guaguguuuccaaaguuuua

SEQ ID NO: 6836 - RNA, 20 nt, Artificial Sequence
  spacer sequence
aaaguuuuaaaauuauggua

SEQ ID NO: 6837 - RNA, 20 nt, Artificial Sequence
  spacer sequence
caguaagugguuaaaacaac

SEQ ID NO: 6838 - RNA, 20 nt, Artificial Sequence
  spacer sequence
uuaaaucucaguagagaauu

SEQ ID NO: 6839 - RNA, 20 nt, Artificial Sequence
  spacer sequence
caguagagaauuuuuaaaaa

SEQ ID NO: 6840 - RNA, 20 nt, Artificial Sequence
  spacer sequence
guagagaauuuuuaaaaagc

SEQ ID NO: 6841 - RNA, 20 nt, Artificial Sequence
  spacer sequence
acugagauuuaaagaauggu

SEQ ID NO: 6842 - RNA, 20 nt, Artificial Sequence
  spacer sequence
cuacugagauuuaaagaaug

SEQ ID NO: 6843 - RNA, 20 nt, Artificial Sequence
  spacer sequence
cuaauguaguuuguugccua

SEQ ID NO: 6844 - RNA, 20 nt, Artificial Sequence
  spacer sequence
acauaggcaacaaacuacau

SEQ ID NO: 6845 - RNA, 20 nt, Artificial Sequence
  spacer sequence
auuagagacucacuuaugcc

SEQ ID NO: 6846 - RNA, 20 nt, Artificial Sequence
  spacer sequence
aauugaguuauuccacauag

SEQ ID NO: 6847 - RNA, 20 nt, Artificial Sequence
  spacer sequence
cuaauugaguuauuccacau

SEQ ID NO: 6848 - RNA, 20 nt, Artificial Sequence
  spacer sequence
cuuaugccuuuugaaacuuc

SEQ ID NO: 6849 - RNA, 20 nt, Artificial Sequence
  spacer sequence
aaaggcauaagugagucucu

SEQ ID NO: 6850 - RNA, 20 nt, Artificial Sequence
  spacer sequence
aauauaauuacacuaccagu

SEQ ID NO: 6851 - RNA, 20 nt, Artificial Sequence
  spacer sequence
uauaugcacauguaaaaacu

SEQ ID NO: 6852 - RNA, 20 nt, Artificial Sequence
  spacer sequence
caauacuuuaaauuggaaau

SEQ ID NO: 6853 - RNA, 20 nt, Artificial Sequence
  spacer sequence
aauuuaaaguauugggacca

SEQ ID NO: 6854 - RNA, 20 nt, Artificial Sequence
  spacer sequence
uucaagucuggauguugggu

SEQ ID NO: 6855 - RNA, 20 nt, Artificial Sequence
  spacer sequence
agucuggauguuggguaauc

SEQ ID NO: 6856 - RNA, 20 nt, Artificial Sequence
  spacer sequence
ggauguuggguaaucacguu

SEQ ID NO: 6857 - RNA, 20 nt, Artificial Sequence
  spacer sequence
agacuugaaggacuuacagc

SEQ ID NO: 6858 - RNA, 20 nt, Artificial Sequence
  spacer sequence
cguuuucuuccagaagccau

SEQ ID NO: 6859 - RNA, 20 nt, Artificial Sequence
  spacer sequence
uccagaagccauuuguuagg

SEQ ID NO: 6860 - RNA, 20 nt, Artificial Sequence
  spacer sequence
agaagccauuuguuaggacu

SEQ ID NO: 6861 - RNA, 20 nt, Artificial Sequence
  spacer sequence
ggaagaaaacgugauuaccc

SEQ ID NO: 6862 - RNA, 20 nt, Artificial Sequence
  spacer sequence
uaacaaauggcuucuggaag

SEQ ID NO: 6863 - RNA, 20 nt, Artificial Sequence
  spacer sequence
cagugggccaguguaaaauu

SEQ ID NO: 6864 - RNA, 20 nt, Artificial Sequence
  spacer sequence
gugggccaguguaaaauuaa

SEQ ID NO: 6865 - RNA, 20 nt, Artificial Sequence
  spacer sequence
uuaauuuuacacuggcccac

SEQ ID NO: 6866 - RNA, 20 nt, Artificial Sequence
  spacer sequence
guaaauuuaaauuauaaaac

SEQ ID NO: 6867 - RNA, 20 nt, Artificial Sequence
  spacer sequence
cucauuuucuaaaggcagga

SEQ ID NO: 6868 - RNA, 20 nt, Artificial Sequence
  spacer sequence
cauuuucuaaaggcaggaau

SEQ ID NO: 6869 - RNA, 20 nt, Artificial Sequence
  spacer sequence
uuuucuaaaggcaggaauau

SEQ ID NO: 6870 - RNA, 20 nt, Artificial Sequence
  spacer sequence
aaaggcaggaauauaaggac

SEQ ID NO: 6871 - RNA, 20 nt, Artificial Sequence
  spacer sequence
ugccuuuagaaaaugagaga

SEQ ID NO: 6872 - RNA, 20 nt, Artificial Sequence
  spacer sequence
uuauauuccugccuuuagaa

SEQ ID NO: 6873 - RNA, 20 nt, Artificial Sequence
  spacer sequence
agggcaauguccuuauauuc

SEQ ID NO: 6874 - RNA, 20 nt, Artificial Sequence
  spacer sequence
ccccaucaaaccaaaggucu

SEQ ID NO: 6875 - RNA, 20 nt, Artificial Sequence
  spacer sequence
ccaucaaaccaaaggucuug

SEQ ID NO: 6876 - RNA, 20 nt, Artificial Sequence
  spacer sequence
aaccaaaggucuugcugcug

SEQ ID NO: 6877 - RNA, 20 nt, Artificial Sequence
  spacer sequence
ugcugcugaguauuauuuaa

SEQ ID NO: 6878 - RNA, 20 nt, Artificial Sequence
  spacer sequence
gcagcaagaccuuugguuug

SEQ ID NO: 6879 - RNA, 20 nt, Artificial Sequence
  spacer sequence
gguuuuuaaauaauacucag

SEQ ID NO: 6880 - RNA, 20 nt, Artificial Sequence
  spacer sequence
ccugaggaugaaggcaaaga

SEQ ID NO: 6881 - RNA, 20 nt, Artificial Sequence
  spacer sequence
ggcgaagcugcuuuauuacu

SEQ ID NO: 6882 - RNA, 20 nt, Artificial Sequence
  spacer sequence
ucaggcgaagcugcuuuauu

SEQ ID NO: 6883 - RNA, 20 nt, Artificial Sequence
  spacer sequence
uccucaggcgaagcugcuuu

SEQ ID NO: 6884 - RNA, 20 nt, Artificial Sequence
  spacer sequence
uugccuucauccucaggcga

SEQ ID NO: 6885 - RNA, 20 nt, Artificial Sequence
  spacer sequence
gcauacugaaaccaggaguu

SEQ ID NO: 6886 - RNA, 20 nt, Artificial Sequence
  spacer sequence
guaugcugagcaguuaacuu

SEQ ID NO: 6887 - RNA, 20 nt, Artificial Sequence
  spacer sequence
ugguuucaguaugcugagca

SEQ ID NO: 6888 - RNA, 20 nt, Artificial Sequence
  spacer sequence
aacuccugguuucaguaugc

SEQ ID NO: 6889 - RNA, 20 nt, Artificial Sequence
  spacer sequence
aaacaacuucaaggccauaa

SEQ ID NO: 6890 - RNA, 20 nt, Artificial Sequence
  spacer sequence
aggccauaaauacuuggaua

SEQ ID NO: 6891 - RNA, 20 nt, Artificial Sequence
  spacer sequence
aaguauuuauggccuugaag

SEQ ID NO: 6892 - RNA, 20 nt, Artificial Sequence
  spacer sequence
cacuauccaaguauuuaugg

SEQ ID NO: 6893 - RNA, 20 nt, Artificial Sequence
  spacer sequence
ggucuuggcacuggauuucc

SEQ ID NO: 6894 - RNA, 20 nt, Artificial Sequence
  spacer sequence
uggcacuggauuuccugcaa

SEQ ID NO: 6895 - RNA, 20 nt, Artificial Sequence
  spacer sequence
agugccaagaccugauguca

SEQ ID NO: 6896 - RNA, 20 nt, Artificial Sequence
  spacer sequence
ugcaauuucagaugaaggcu

SEQ ID NO: 6897 - RNA, 20 nt, Artificial Sequence
  spacer sequence
gaugaaggcuugacuuggcu

SEQ ID NO: 6898 - RNA, 20 nt, Artificial Sequence
  spacer sequence
gaaauugcaggaaauccagu

SEQ ID NO: 6899 - RNA, 20 nt, Artificial Sequence
  spacer sequence
ucugaaauugcaggaaaucc

SEQ ID NO: 6900 - RNA, 20 nt, Artificial Sequence
  spacer sequence
agccuucaucugaaauugca

SEQ ID NO: 6901 - RNA, 20 nt, Artificial Sequence
  spacer sequence
aaagccaagucaagccuuca

SEQ ID NO: 6902 - RNA, 20 nt, Artificial Sequence
  spacer sequence
ugugauaauucuuggauaac

SEQ ID NO: 6903 - RNA, 20 nt, Artificial Sequence
  spacer sequence
caugaaaacaucuaaagcca

SEQ ID NO: 6904 - RNA, 20 nt, Artificial Sequence
  spacer sequence
uggauaaccuacaacgauuu

SEQ ID NO: 6905 - RNA, 20 nt, Artificial Sequence
  spacer sequence
aagaauuaucacaugaaaac

SEQ ID NO: 6906 - RNA, 20 nt, Artificial Sequence
  spacer sequence
uuguagguuauccaagaauu

SEQ ID NO: 6907 - RNA, 20 nt, Artificial Sequence
  spacer sequence
uauuuaacccaccaacuuua

SEQ ID NO: 6908 - RNA, 20 nt, Artificial Sequence
  spacer sequence
uuugcuuaaaguuggugggu

SEQ ID NO: 6909 - RNA, 20 nt, Artificial Sequence
  spacer sequence
uucuuuugcuuaaaguuggu

SEQ ID NO: 6910 - RNA, 20 nt, Artificial Sequence
  spacer sequence
cccacauauacguucuuucu

SEQ ID NO: 6911 - RNA, 20 nt, Artificial Sequence
  spacer sequence
uuuaccucugccccgcaggg

SEQ ID NO: 6912 - RNA, 20 nt, Artificial Sequence
  spacer sequence
gccccgcaggggaauuaaaa

SEQ ID NO: 6913 - RNA, 20 nt, Artificial Sequence
  spacer sequence
ccugcggggcagagguaaac

SEQ ID NO: 6914 - RNA, 20 nt, Artificial Sequence
  spacer sequence
ccagcguuuuaauuccccug

SEQ ID NO: 6915 - RNA, 20 nt, Artificial Sequence
  spacer sequence
ucaccagcguuuuaauuccc

SEQ ID NO: 6916 - RNA, 20 nt, Artificial Sequence
  spacer sequence
uuauauaagccuugccuguu

SEQ ID NO: 6917 - RNA, 20 nt, Artificial Sequence
  spacer sequence
gugcagccuacuacuguuuc

SEQ ID NO: 6918 - RNA, 20 nt, Artificial Sequence
  spacer sequence
ucaaacacaacaaaaagcuc

SEQ ID NO: 6919 - RNA, 20 nt, Artificial Sequence
  spacer sequence
aacacaacaaaaagcucuua

SEQ ID NO: 6920 - RNA, 20 nt, Artificial Sequence
  spacer sequence
uagguugcaaauguuaaccu

SEQ ID NO: 6921 - RNA, 20 nt, Artificial Sequence
  spacer sequence
agguuaacauuugcaaccua

SEQ ID NO: 6922 - RNA, 20 nt, Artificial Sequence
  spacer sequence
uuuacccuuuugaaaaauuc

SEQ ID NO: 6923 - RNA, 20 nt, Artificial Sequence
  spacer sequence
aaaggguaaaagaaucaagg

SEQ ID NO: 6924 - RNA, 20 nt, Artificial Sequence
  spacer sequence
augggaugguuggaaaaaaa

SEQ ID NO: 6925 - RNA, 20 nt, Artificial Sequence
  spacer sequence
cauugaauuuuucaaaaggg

SEQ ID NO: 6926 - RNA, 20 nt, Artificial Sequence
  spacer sequence
aaccaucccauugaauuuuu

SEQ ID NO: 6927 - RNA, 20 nt, Artificial Sequence
  spacer sequence
gugguuuuuuuuuuuuccaa

SEQ ID NO: 6928 - RNA, 20 nt, Artificial Sequence
  spacer sequence
aacguaauacccaggcaguc

SEQ ID NO: 6929 - RNA, 20 nt, Artificial Sequence
  spacer sequence
gauaauuuauaguacaacgu

SEQ ID NO: 6930 - RNA, 20 nt, Artificial Sequence
  spacer sequence
gacugccuggguauuacguu

SEQ ID NO: 6931 - RNA, 20 nt, Artificial Sequence
  spacer sequence
caguguuacacguuguacua

SEQ ID NO: 6932 - RNA, 20 nt, Artificial Sequence
  spacer sequence
aacuuuucacccagcaaaau

SEQ ID NO: 6933 - RNA, 20 nt, Artificial Sequence
  spacer sequence
cccagcaaaaucuccuuaca

SEQ ID NO: 6934 - RNA, 20 nt, Artificial Sequence
  spacer sequence
ccuuacaaauuagggcaaca

SEQ ID NO: 6935 - RNA, 20 nt, Artificial Sequence
  spacer sequence
uuacaaauuagggcaacaua

SEQ ID NO: 6936 - RNA, 20 nt, Artificial Sequence
  spacer sequence
auuggcuuugugguauaugu

SEQ ID NO: 6937 - RNA, 20 nt, Artificial Sequence
  spacer sequence
uuuuuuuuccauuggcuuug

SEQ ID NO: 6938 - RNA, 20 nt, Artificial Sequence
  spacer sequence
auugaauugcaaacacagcu

SEQ ID NO: 6939 - RNA, 20 nt, Artificial Sequence
  spacer sequence
agguuuucuuuuuuuuucca

SEQ ID NO: 6940 - RNA, 20 nt, Artificial Sequence
  spacer sequence
aucgagguuuucuuuuuuuu

SEQ ID NO: 6941 - RNA, 20 nt, Artificial Sequence
  spacer sequence
auugacauuaaaacaacuaa

SEQ ID NO: 6942 - RNA, 20 nt, Artificial Sequence
  spacer sequence
auugaaaagcuguguuugca

SEQ ID NO: 6943 - RNA, 20 nt, Artificial Sequence
  spacer sequence
uaagguaaagguuaguuguu

SEQ ID NO: 6944 - RNA, 20 nt, Artificial Sequence
  spacer sequence
gucauaagguaaagguuagu

SEQ ID NO: 6945 - RNA, 20 nt, Artificial Sequence
  spacer sequence
aaaguauuacauaugaaagu

SEQ ID NO: 6946 - RNA, 20 nt, Artificial Sequence
  spacer sequence
uauguaauacuuuugauuuu

SEQ ID NO: 6947 - RNA, 20 nt, Artificial Sequence
  spacer sequence
cuuucauauguaauacuuuu

SEQ ID NO: 6948 - RNA, 20 nt, Artificial Sequence
  spacer sequence
cacuuucauauguaauacuu

SEQ ID NO: 6949 - RNA, 20 nt, Artificial Sequence
  spacer sequence
auuuucaucaaauaagucua

SEQ ID NO: 6950 - RNA, 20 nt, Artificial Sequence
  spacer sequence
ucaaauaagucuaauuuaga

SEQ ID NO: 6951 - RNA, 20 nt, Artificial Sequence
  spacer sequence
aauaagucuaauuuagacuc

SEQ ID NO: 6952 - RNA, 20 nt, Artificial Sequence
  spacer sequence
aauuuagacuccaauacagu

SEQ ID NO: 6953 - RNA, 20 nt, Artificial Sequence
  spacer sequence
aaauuagacuuauuugauga

SEQ ID NO: 6954 - RNA, 20 nt, Artificial Sequence
  spacer sequence
aauacaguauuaacagcuca

SEQ ID NO: 6955 - RNA, 20 nt, Artificial Sequence
  spacer sequence
aacuuugacggugaacaauc

SEQ ID NO: 6956 - RNA, 20 nt, Artificial Sequence
  spacer sequence
aaguuugagcuguuaauacu

SEQ ID NO: 6957 - RNA, 20 nt, Artificial Sequence
  spacer sequence
ccgucaaaguuugagcuguu

SEQ ID NO: 6958 - RNA, 20 nt, Artificial Sequence
  spacer sequence
uuuuccaccuuaaugcagug

SEQ ID NO: 6959 - RNA, 20 nt, Artificial Sequence
  spacer sequence
accuuaaugcaguguaggaa

SEQ ID NO: 6960 - RNA, 20 nt, Artificial Sequence
  spacer sequence
uacacugcauuaagguggaa

SEQ ID NO: 6961 - RNA, 20 nt, Artificial Sequence
  spacer sequence
uccuacacugcauuaaggug

SEQ ID NO: 6962 - RNA, 20 nt, Artificial Sequence
  spacer sequence
uaacaaacuuuaaugugugc

SEQ ID NO: 6963 - RNA, 20 nt, Artificial Sequence
  spacer sequence
auuuucguaacaaacuuuaa

SEQ ID NO: 6964 - RNA, 20 nt, Artificial Sequence
  spacer sequence
cuauuguuuugaggagcuuu

SEQ ID NO: 6965 - RNA, 20 nt, Artificial Sequence
  spacer sequence
aaacaauagggauguuuuua

SEQ ID NO: 6966 - RNA, 20 nt, Artificial Sequence
  spacer sequence
ucaaaacaauagggauguuu

SEQ ID NO: 6967 - RNA, 20 nt, Artificial Sequence
  spacer sequence
ccguuaccuugucuuaaauu

SEQ ID NO: 6968 - RNA, 20 nt, Artificial Sequence
  spacer sequence
uaaauuaaaaaaaaaaaaaa

SEQ ID NO: 6969 - RNA, 20 nt, Artificial Sequence
  spacer sequence
auuuuuuuuuuuuuuuuuaa

SEQ ID NO: 6970 - RNA, 20 nt, Artificial Sequence
  spacer sequence
cuauuuuuuuuuuuuuuuuu

SEQ ID NO: 6971 - RNA, 20 nt, Artificial Sequence
  spacer sequence
aauuacgauuuguaaacuuu

SEQ ID NO: 6972 - RNA, 20 nt, Artificial Sequence
  spacer sequence
uaauuagaagugcucucuau

SEQ ID NO: 6973 - RNA, 20 nt, Artificial Sequence
  spacer sequence
aaacuuuuaaaaaguuacag

SEQ ID NO: 6974 - RNA, 20 nt, Artificial Sequence
  spacer sequence
uauuuucaguauuuuuuguu

SEQ ID NO: 6975 - RNA, 20 nt, Artificial Sequence
  spacer sequence
guauuuuuuguuauuuugug

SEQ ID NO: 6976 - RNA, 20 nt, Artificial Sequence
  spacer sequence
auuuaaaaauagccacaaaa

SEQ ID NO: 6977 - RNA, 20 nt, Artificial Sequence
  spacer sequence
cuucuauuuaaaaauagcca

SEQ ID NO: 6978 - RNA, 20 nt, Artificial Sequence
  spacer sequence
aauugcuuacaguuccccac

SEQ ID NO: 6979 - RNA, 20 nt, Artificial Sequence
  spacer sequence
ccaccagcuggcgcggggcu

SEQ ID NO: 6980 - RNA, 20 nt, Artificial Sequence
  spacer sequence
cgcuguacugcagccccgcg

SEQ ID NO: 6981 - RNA, 20 nt, Artificial Sequence
  spacer sequence
gcucccgcuguacugcagcc

SEQ ID NO: 6982 - RNA, 20 nt, Artificial Sequence
  spacer sequence
guacaccucaagcucuacac

SEQ ID NO: 6983 - RNA, 20 nt, Artificial Sequence
  spacer sequence
agcucuacacuccaggaagu

SEQ ID NO: 6984 - RNA, 20 nt, Artificial Sequence
  spacer sequence
acacuccaggaagugucacu

SEQ ID NO: 6985 - RNA, 20 nt, Artificial Sequence
  spacer sequence
aggaagugucacugucacau

SEQ ID NO: 6986 - RNA, 20 nt, Artificial Sequence
  spacer sequence
uggaguguagagcuugaggu

SEQ ID NO: 6987 - RNA, 20 nt, Artificial Sequence
  spacer sequence
cugucacauuuucacaaauu

SEQ ID NO: 6988 - RNA, 20 nt, Artificial Sequence
  spacer sequence
cauuuucacaaauuccaguc

SEQ ID NO: 6989 - RNA, 20 nt, Artificial Sequence
  spacer sequence
caaauuccagucucuaacga

SEQ ID NO: 6990 - RNA, 20 nt, Artificial Sequence
  spacer sequence
agucucuaacgaggagccuc

SEQ ID NO: 6991 - RNA, 20 nt, Artificial Sequence
  spacer sequence
cuaacgaggagccucugcug

SEQ ID NO: 6992 - RNA, 20 nt, Artificial Sequence
  spacer sequence
aacgaggagccucugcugcu

SEQ ID NO: 6993 - RNA, 20 nt, Artificial Sequence
  spacer sequence
uuagagacuggaauuuguga

SEQ ID NO: 6994 - RNA, 20 nt, Artificial Sequence
  spacer sequence
ucguuagagacuggaauuug

SEQ ID NO: 6995 - RNA, 20 nt, Artificial Sequence
  spacer sequence
gcugcugagccagaauccuu

SEQ ID NO: 6996 - RNA, 20 nt, Artificial Sequence
  spacer sequence
gcagcagaggcuccucguua

SEQ ID NO: 6997 - RNA, 20 nt, Artificial Sequence
  spacer sequence
ggcucagcagcagaggcucc

SEQ ID NO: 6998 - RNA, 20 nt, Artificial Sequence
  spacer sequence
uuuucggguucaacggauga

SEQ ID NO: 6999 - RNA, 20 nt, Artificial Sequence
  spacer sequence
gguucaacggaugagguagc

SEQ ID NO: 7000 - RNA, 20 nt, Artificial Sequence
  spacer sequence
acggaugagguagccucagc

SEQ ID NO: 7001 - RNA, 20 nt, Artificial Sequence
  spacer sequence
guugaacccgaaaaggauuc

SEQ ID NO: 7002 - RNA, 20 nt, Artificial Sequence
  spacer sequence
uccguugaacccgaaaagga

SEQ ID NO: 7003 - RNA, 20 nt, Artificial Sequence
  spacer sequence
gcagguaacucuucagaagg

SEQ ID NO: 7004 - RNA, 20 nt, Artificial Sequence
  spacer sequence
ucagaaggcuuuaggacugc

SEQ ID NO: 7005 - RNA, 20 nt, Artificial Sequence
  spacer sequence
gaaggcuuuaggacugcagc

SEQ ID NO: 7006 - RNA, 20 nt, Artificial Sequence
  spacer sequence
gaagaguuaccugcugaggc

SEQ ID NO: 7007 - RNA, 20 nt, Artificial Sequence
  spacer sequence
uaaagccuucugaagaguua

SEQ ID NO: 7008 - RNA, 20 nt, Artificial Sequence
  spacer sequence
gacacccccuucucaaguuc

SEQ ID NO: 7009 - RNA, 20 nt, Artificial Sequence
  spacer sequence
gaggcugcaguccuaaagcc

SEQ ID NO: 7010 - RNA, 20 nt, Artificial Sequence
  spacer sequence
caaguucugaagcagugucu

SEQ ID NO: 7011 - RNA, 20 nt, Artificial Sequence
  spacer sequence
aguucugaagcagugucuac

SEQ ID NO: 7012 - RNA, 20 nt, Artificial Sequence
  spacer sequence
gaagcagugucuacauuucc

SEQ ID NO: 7013 - RNA, 20 nt, Artificial Sequence
  spacer sequence
gaacuugagaaggggguguc

SEQ ID NO: 7014 - RNA, 20 nt, Artificial Sequence
  spacer sequence
acauuucccacuuggcuaau

SEQ ID NO: 7015 - RNA, 20 nt, Artificial Sequence
  spacer sequence
cacuuggcuaaugggagguu

SEQ ID NO: 7016 - RNA, 20 nt, Artificial Sequence
  spacer sequence
cauuagccaagugggaaaug

SEQ ID NO: 7017 - RNA, 20 nt, Artificial Sequence
  spacer sequence
acgguuuuguuaccaccugc

SEQ ID NO: 7018 - RNA, 20 nt, Artificial Sequence
  spacer sequence
gucaccucaggcuuuuccuu

SEQ ID NO: 7019 - RNA, 20 nt, Artificial Sequence
  spacer sequence
ccucaggcuuuuccuuuccu

SEQ ID NO: 7020 - RNA, 20 nt, Artificial Sequence
  spacer sequence
ggcuuuuccuuuccucgggc

SEQ ID NO: 7021 - RNA, 20 nt, Artificial Sequence
  spacer sequence
uuuccucgggcuucuuccuu

SEQ ID NO: 7022 - RNA, 20 nt, Artificial Sequence
  spacer sequence
ucgggcuucuuccuucucuc

SEQ ID NO: 7023 - RNA, 20 nt, Artificial Sequence
  spacer sequence
ggcuucuuccuucucucuac

SEQ ID NO: 7024 - RNA, 20 nt, Artificial Sequence
  spacer sequence
uccuucucucuacgagacuc

SEQ ID NO: 7025 - RNA, 20 nt, Artificial Sequence
  spacer sequence
uucucucuacgagacucucu

SEQ ID NO: 7026 - RNA, 20 nt, Artificial Sequence
  spacer sequence
cucuacgagacucucuaucu

SEQ ID NO: 7027 - RNA, 20 nt, Artificial Sequence
  spacer sequence
cuacgagacucucuaucucu

SEQ ID NO: 7028 - RNA, 20 nt, Artificial Sequence
  spacer sequence
acgagacucucuaucucuag

SEQ ID NO: 7029 - RNA, 20 nt, Artificial Sequence
  spacer sequence
uagagagaaggaagaagccc

SEQ ID NO: 7030 - RNA, 20 nt, Artificial Sequence
  spacer sequence
cguagagagaaggaagaagc

SEQ ID NO: 7031 - RNA, 20 nt, Artificial Sequence
  spacer sequence
cuaucucuagaaucucucuc

SEQ ID NO: 7032 - RNA, 20 nt, Artificial Sequence
  spacer sequence
aucucuagaaucucucucuc

SEQ ID NO: 7033 - RNA, 20 nt, Artificial Sequence
  spacer sequence
cuagaaucucucucucuguc

SEQ ID NO: 7034 - RNA, 20 nt, Artificial Sequence
  spacer sequence
agaaucucucucucugucuc

SEQ ID NO: 7035 - RNA, 20 nt, Artificial Sequence
  spacer sequence
agagauagagagucucguag

SEQ ID NO: 7036 - RNA, 20 nt, Artificial Sequence
  spacer sequence
cucucucugucucgaugccc

SEQ ID NO: 7037 - RNA, 20 nt, Artificial Sequence
  spacer sequence
cucucugucucgaugcccac

SEQ ID NO: 7038 - RNA, 20 nt, Artificial Sequence
  spacer sequence
cucugucucgaugcccacua

SEQ ID NO: 7039 - RNA, 20 nt, Artificial Sequence
  spacer sequence
cugucucgaugcccacuaga

SEQ ID NO: 7040 - RNA, 20 nt, Artificial Sequence
  spacer sequence
gucucgaugcccacuagagc

SEQ ID NO: 7041 - RNA, 20 nt, Artificial Sequence
  spacer sequence
cgaugcccacuagagcgucu

SEQ ID NO: 7042 - RNA, 20 nt, Artificial Sequence
  spacer sequence
augcccacuagagcgucuau

SEQ ID NO: 7043 - RNA, 20 nt, Artificial Sequence
  spacer sequence
agacagagagagagauucua

SEQ ID NO: 7044 - RNA, 20 nt, Artificial Sequence
  spacer sequence
agugggcaucgagacagaga

SEQ ID NO: 7045 - RNA, 20 nt, Artificial Sequence
  spacer sequence
auuucucucuuccaagucuc

SEQ ID NO: 7046 - RNA, 20 nt, Artificial Sequence
  spacer sequence
cucuuccaagucucugugcc

SEQ ID NO: 7047 - RNA, 20 nt, Artificial Sequence
  spacer sequence
cuuccaagucucugugccug

SEQ ID NO: 7048 - RNA, 20 nt, Artificial Sequence
  spacer sequence
uccaagucucugugccuguc

SEQ ID NO: 7049 - RNA, 20 nt, Artificial Sequence
  spacer sequence
aagucucugugccugucccg

SEQ ID NO: 7050 - RNA, 20 nt, Artificial Sequence
  spacer sequence
cugugccugucccggucagg

SEQ ID NO: 7051 - RNA, 20 nt, Artificial Sequence
  spacer sequence
gugccugucccggucagggc

SEQ ID NO: 7052 - RNA, 20 nt, Artificial Sequence
  spacer sequence
cggucagggcuccuccuucc

SEQ ID NO: 7053 - RNA, 20 nt, Artificial Sequence
  spacer sequence
gggcuccuccuuccccacuc

SEQ ID NO: 7054 - RNA, 20 nt, Artificial Sequence
  spacer sequence
uccuuccccacucucuccug

SEQ ID NO: 7055 - RNA, 20 nt, Artificial Sequence
  spacer sequence
uuccccacucucuccuguca

SEQ ID NO: 7056 - RNA, 20 nt, Artificial Sequence
  spacer sequence
ccacucucuccugucacggu

SEQ ID NO: 7057 - RNA, 20 nt, Artificial Sequence
  spacer sequence
cuccugucacgguuacuauu

SEQ ID NO: 7058 - RNA, 20 nt, Artificial Sequence
  spacer sequence
ccugucacgguuacuauuau

SEQ ID NO: 7059 - RNA, 20 nt, Artificial Sequence
  spacer sequence
ugucacgguuacuauuaucu

SEQ ID NO: 7060 - RNA, 20 nt, Artificial Sequence
  spacer sequence
cgguuacuauuaucucuauc

SEQ ID NO: 7061 - RNA, 20 nt, Artificial Sequence
  spacer sequence
cuaucaucauuacgguuccc

SEQ ID NO: 7062 - RNA, 20 nt, Artificial Sequence
  spacer sequence
aucaucauuacgguucccau

SEQ ID NO: 7063 - RNA, 20 nt, Artificial Sequence
  spacer sequence
ucauuacgguucccauaccg

SEQ ID NO: 7064 - RNA, 20 nt, Artificial Sequence
  spacer sequence
uuacgguucccauaccguuc

SEQ ID NO: 7065 - RNA, 20 nt, Artificial Sequence
  spacer sequence
cauaccguucccggucauuu

SEQ ID NO: 7066 - RNA, 20 nt, Artificial Sequence
  spacer sequence
cggucauuuuccacccuauu

SEQ ID NO: 7067 - RNA, 20 nt, Artificial Sequence
  spacer sequence
uuuuccacccuauuuccaaa

SEQ ID NO: 7068 - RNA, 20 nt, Artificial Sequence
  spacer sequence
acccuauuuccaaaagaucu

SEQ ID NO: 7069 - RNA, 20 nt, Artificial Sequence
  spacer sequence
aaaagaucuucuuccaaacc

SEQ ID NO: 7070 - RNA, 20 nt, Artificial Sequence
  spacer sequence
uuuggaaauaggguggaaaa

SEQ ID NO: 7071 - RNA, 20 nt, Artificial Sequence
  spacer sequence
ucuuccaaaccuuucuuggu

SEQ ID NO: 7072 - RNA, 20 nt, Artificial Sequence
  spacer sequence
uccaaaccuuucuuggucuc

SEQ ID NO: 7073 - RNA, 20 nt, Artificial Sequence
  spacer sequence
aaaccuuucuuggucucuac

SEQ ID NO: 7074 - RNA, 20 nt, Artificial Sequence
  spacer sequence
uggucucuaccugaauugaa

SEQ ID NO: 7075 - RNA, 20 nt, Artificial Sequence
  spacer sequence
cuaccugaauugaacugcug

SEQ ID NO: 7076 - RNA, 20 nt, Artificial Sequence
  spacer sequence
accugaauugaacugcugcc

SEQ ID NO: 7077 - RNA, 20 nt, Artificial Sequence
  spacer sequence
gguagagaccaagaaagguu

SEQ ID NO: 7078 - RNA, 20 nt, Artificial Sequence
  spacer sequence
auucagguagagaccaagaa

SEQ ID NO: 7079 - RNA, 20 nt, Artificial Sequence
  spacer sequence
uuucuaaacugcuguggcug

SEQ ID NO: 7080 - RNA, 20 nt, Artificial Sequence
  spacer sequence
aaacugcuguggcugcugcu

SEQ ID NO: 7081 - RNA, 20 nt, Artificial Sequence
  spacer sequence
accaacacagcagcagccac

SEQ ID NO: 7082 - RNA, 20 nt, Artificial Sequence
  spacer sequence
caacagccuccaccaacaca

SEQ ID NO: 7083 - RNA, 20 nt, Artificial Sequence
  spacer sequence
gucucugucuucaggacccc

SEQ ID NO: 7084 - RNA, 20 nt, Artificial Sequence
  spacer sequence
cugucuucaggacccccugg

SEQ ID NO: 7085 - RNA, 20 nt, Artificial Sequence
  spacer sequence
gucuucaggacccccugggc

SEQ ID NO: 7086 - RNA, 20 nt, Artificial Sequence
  spacer sequence
ucaggacccccugggccugg

SEQ ID NO: 7087 - RNA, 20 nt, Artificial Sequence
  spacer sequence
ggacccccugggccuggccc

SEQ ID NO: 7088 - RNA, 20 nt, Artificial Sequence
  spacer sequence
ugaagacagagacggaaggc

SEQ ID NO: 7089 - RNA, 20 nt, Artificial Sequence
  spacer sequence
ggggcccagggccaggccca

SEQ ID NO: 7090 - RNA, 20 nt, Artificial Sequence
  spacer sequence
accaggccuaacaaaggggc

SEQ ID NO: 7091 - RNA, 20 nt, Artificial Sequence
  spacer sequence
caccgcauggccccuuuguu

SEQ ID NO: 7092 - RNA, 20 nt, Artificial Sequence
  spacer sequence
cuucccaccgcauggccccu

SEQ ID NO: 7093 - RNA, 20 nt, Artificial Sequence
  spacer sequence
uuccaugagguggaggcauc

SEQ ID NO: 7094 - RNA, 20 nt, Artificial Sequence
  spacer sequence
augagguggaggcaucgcaa

SEQ ID NO: 7095 - RNA, 20 nt, Artificial Sequence
  spacer sequence
uggaaugaaaggucccuucc

SEQ ID NO: 7096 - RNA, 20 nt, Artificial Sequence
  spacer sequence
accucauggaaugaaagguc

SEQ ID NO: 7097 - RNA, 20 nt, Artificial Sequence
  spacer sequence
caaagcccccugguccuggc

SEQ ID NO: 7098 - RNA, 20 nt, Artificial Sequence
  spacer sequence
uggcggugggccucugugca

SEQ ID NO: 7099 - RNA, 20 nt, Artificial Sequence
  spacer sequence
gugcaucaugugcgguggca

SEQ ID NO: 7100 - RNA, 20 nt, Artificial Sequence
  spacer sequence
ugugcgguggcaugggacgg

SEQ ID NO: 7101 - RNA, 20 nt, Artificial Sequence
  spacer sequence
caugccaccgcacaugaugc

SEQ ID NO: 7102 - RNA, 20 nt, Artificial Sequence
  spacer sequence
aagggaaccgcuguaaguga

SEQ ID NO: 7103 - RNA, 20 nt, Artificial Sequence
  spacer sequence
cuuugaugccgccccguccc

SEQ ID NO: 7104 - RNA, 20 nt, Artificial Sequence
  spacer sequence
cuuacagcgguucccuuuga

SEQ ID NO: 7105 - RNA, 20 nt, Artificial Sequence
  spacer sequence
uggagggcgcuggaguggga

SEQ ID NO: 7106 - RNA, 20 nt, Artificial Sequence
  spacer sequence
aggaaugcccccaccucacu

SEQ ID NO: 7107 - RNA, 20 nt, Artificial Sequence
  spacer sequence
agcgcccuccaggaaugccc

SEQ ID NO: 7108 - RNA, 20 nt, Artificial Sequence
  spacer sequence
cacuccagcgcccuccagga

SEQ ID NO: 7109 - RNA, 20 nt, Artificial Sequence
  spacer sequence
ucccacuccagcgcccucca

SEQ ID NO: 7110 - RNA, 20 nt, Artificial Sequence
  spacer sequence
caucccacuccagcgcccuc

SEQ ID NO: 7111 - RNA, 20 nt, Artificial Sequence
  spacer sequence
uggcgcccggcccggucuca

SEQ ID NO: 7112 - RNA, 20 nt, Artificial Sequence
  spacer sequence
ucuuggcgcccggcccgguc

SEQ ID NO: 7113 - RNA, 20 nt, Artificial Sequence
  spacer sequence
acuggucuucuuggcgcccg

SEQ ID NO: 7114 - RNA, 20 nt, Artificial Sequence
  spacer sequence
ggcaccaucuacuggucuuc

SEQ ID NO: 7115 - RNA, 20 nt, Artificial Sequence
  spacer sequence
aauuacaggaccaggggcaa

SEQ ID NO: 7116 - RNA, 20 nt, Artificial Sequence
  spacer sequence
uguaauuggacuucaggcac

SEQ ID NO: 7117 - RNA, 20 nt, Artificial Sequence
  spacer sequence
uugagugccuaaaagacgac

SEQ ID NO: 7118 - RNA, 20 nt, Artificial Sequence
  spacer sequence
aggaguugccccugguccug

SEQ ID NO: 7119 - RNA, 20 nt, Artificial Sequence
  spacer sequence
uuuaggcacucaaggaguug

SEQ ID NO: 7120 - RNA, 20 nt, Artificial Sequence
  spacer sequence
ucuuuuaggcacucaaggag

SEQ ID NO: 7121 - RNA, 20 nt, Artificial Sequence
  spacer sequence
gugguguuuacauuuuuauu

SEQ ID NO: 7122 - RNA, 20 nt, Artificial Sequence
  spacer sequence
ucggugguguuuacauuuuu

SEQ ID NO: 7123 - RNA, 20 nt, Artificial Sequence
  spacer sequence
aguuucagcuguguucugug

SEQ ID NO: 7124 - RNA, 20 nt, Artificial Sequence
  spacer sequence
gcuguguucuguggcgcuua

SEQ ID NO: 7125 - RNA, 20 nt, Artificial Sequence
  spacer sequence
guggcgcuuaaagcaaaaua

SEQ ID NO: 7126 - RNA, 20 nt, Artificial Sequence
  spacer sequence
acccacaaucuucaaauuuc

SEQ ID NO: 7127 - RNA, 20 nt, Artificial Sequence
  spacer sequence
ucaaauuucauaguuugcca

SEQ ID NO: 7128 - RNA, 20 nt, Artificial Sequence
  spacer sequence
aauuucauaguuugccacuc

SEQ ID NO: 7129 - RNA, 20 nt, Artificial Sequence
  spacer sequence
uaguuugccacucugucaca

SEQ ID NO: 7130 - RNA, 20 nt, Artificial Sequence
  spacer sequence
gucacaaacccagugugagg

SEQ ID NO: 7131 - RNA, 20 nt, Artificial Sequence
  spacer sequence
caaacccagugugaggccua

SEQ ID NO: 7132 - RNA, 20 nt, Artificial Sequence
  spacer sequence
cacuggguuugugacagagu

SEQ ID NO: 7133 - RNA, 20 nt, Artificial Sequence
  spacer sequence
uugcaauugcuugccuuagg

SEQ ID NO: 7134 - RNA, 20 nt, Artificial Sequence
  spacer sequence
aauacagguagaggccagaa

SEQ ID NO: 7135 - RNA, 20 nt, Artificial Sequence
  spacer sequence
accuguauuagauacuuuaa

SEQ ID NO: 7136 - RNA, 20 nt, Artificial Sequence
  spacer sequence
ggccucuaccuguauuagau

SEQ ID NO: 7137 - RNA, 20 nt, Artificial Sequence
  spacer sequence
caguuuauucuggccucuac

SEQ ID NO: 7138 - RNA, 20 nt, Artificial Sequence
  spacer sequence
aagaguaugucaaaaucucc

SEQ ID NO: 7139 - RNA, 20 nt, Artificial Sequence
  spacer sequence
uugaaaauugguauuaccau

SEQ ID NO: 7140 - RNA, 20 nt, Artificial Sequence
  spacer sequence
aaaucuccuguagcuuucau

SEQ ID NO: 7141 - RNA, 20 nt, Artificial Sequence
  spacer sequence
ccuguagcuuucauuagaag

SEQ ID NO: 7142 - RNA, 20 nt, Artificial Sequence
  spacer sequence
uguagcuuucauuagaagcu

SEQ ID NO: 7143 - RNA, 20 nt, Artificial Sequence
  spacer sequence
uuagaagcugucuucccacu

SEQ ID NO: 7144 - RNA, 20 nt, Artificial Sequence
  spacer sequence
aaugaaagcuacaggagauu

SEQ ID NO: 7145 - RNA, 20 nt, Artificial Sequence
  spacer sequence
ucccacuccaaauacauuug

SEQ ID NO: 7146 - RNA, 20 nt, Artificial Sequence
  spacer sequence
cacuccaaauacauuugaga

SEQ ID NO: 7147 - RNA, 20 nt, Artificial Sequence
  spacer sequence
aaauacauuugagaaacaca

SEQ ID NO: 7148 - RNA, 20 nt, Artificial Sequence
  spacer sequence
aauguauuuggagugggaag

SEQ ID NO: 7149 - RNA, 20 nt, Artificial Sequence
  spacer sequence
caaauguauuuggaguggga

SEQ ID NO: 7150 - RNA, 20 nt, Artificial Sequence
  spacer sequence
uaaugagauaaauacauuca

SEQ ID NO: 7151 - RNA, 20 nt, Artificial Sequence
  spacer sequence
uuaggacuuagcacacugug

SEQ ID NO: 7152 - RNA, 20 nt, Artificial Sequence
  spacer sequence
cauuaggacuuagcacacug

SEQ ID NO: 7153 - RNA, 20 nt, Artificial Sequence
  spacer sequence
cuaucaguaacuauucaagc

SEQ ID NO: 7154 - RNA, 20 nt, Artificial Sequence
  spacer sequence
guaacuauucaagcuaacua

SEQ ID NO: 7155 - RNA, 20 nt, Artificial Sequence
  spacer sequence
agcuaacuaagcauacugca

SEQ ID NO: 7156 - RNA, 20 nt, Artificial Sequence
  spacer sequence
aagugugcaccugcaguaug

SEQ ID NO: 7157 - RNA, 20 nt, Artificial Sequence
  spacer sequence
uauuacuagaaaaaaaugag

SEQ ID NO: 7158 - RNA, 20 nt, Artificial Sequence
  spacer sequence
aguaauaagacgggguguaa

SEQ ID NO: 7159 - RNA, 20 nt, Artificial Sequence
  spacer sequence
uuuuuuucuaguaauaagac

SEQ ID NO: 7160 - RNA, 20 nt, Artificial Sequence
  spacer sequence
cugaccuagaaaacccagga

SEQ ID NO: 7161 - RNA, 20 nt, Artificial Sequence
  spacer sequence
gugaccucauuuuuuucuag

SEQ ID NO: 7162 - RNA, 20 nt, Artificial Sequence
  spacer sequence
aggucagugaccucauuuuu

SEQ ID NO: 7163 - RNA, 20 nt, Artificial Sequence
  spacer sequence
uggguuuucuaggucaguga

SEQ ID NO: 7164 - RNA, 20 nt, Artificial Sequence
  spacer sequence
uuccuggguuuucuagguca

SEQ ID NO: 7165 - RNA, 20 nt, Artificial Sequence
  spacer sequence
ucuuuccuggguuuucuagg

SEQ ID NO: 7166 - RNA, 20 nt, Artificial Sequence
  spacer sequence
uccucuuuccuggguuuucu

SEQ ID NO: 7167 - RNA, 20 nt, Artificial Sequence
  spacer sequence
cuuugacuccaugcuacacu

SEQ ID NO: 7168 - RNA, 20 nt, Artificial Sequence
  spacer sequence
uugacuccaugcuacacuua

SEQ ID NO: 7169 - RNA, 20 nt, Artificial Sequence
  spacer sequence
aagagaucuuccucuuuccu

SEQ ID NO: 7170 - RNA, 20 nt, Artificial Sequence
  spacer sequence
augcuacacuuaguccauau

SEQ ID NO: 7171 - RNA, 20 nt, Artificial Sequence
  spacer sequence
auauuauuaaaaugccucau

SEQ ID NO: 7172 - RNA, 20 nt, Artificial Sequence
  spacer sequence
ugcaguuacuaugcaaugug

SEQ ID NO: 7173 - RNA, 20 nt, Artificial Sequence
  spacer sequence
aauaaacacuaaugucuaca

SEQ ID NO: 7174 - RNA, 20 nt, Artificial Sequence
  spacer sequence
acaaaacaaagauccauaca

SEQ ID NO: 7175 - RNA, 20 nt, Artificial Sequence
  spacer sequence
uuguuuuguagacauuagug

SEQ ID NO: 7176 - RNA, 20 nt, Artificial Sequence
  spacer sequence
auacacaaaugugaaguuua

SEQ ID NO: 7177 - RNA, 20 nt, Artificial Sequence
  spacer sequence
cauuuguguauggaucuuug

SEQ ID NO: 7178 - RNA, 20 nt, Artificial Sequence
  spacer sequence
uuuuucaaggcacagcauga

SEQ ID NO: 7179 - RNA, 20 nt, Artificial Sequence
  spacer sequence
aggcacagcaugauauuuaa

SEQ ID NO: 7180 - RNA, 20 nt, Artificial Sequence
  spacer sequence
ugcugugccuugaaaaagga

SEQ ID NO: 7181 - RNA, 20 nt, Artificial Sequence
  spacer sequence
caaguuaaauaucaugcugu

SEQ ID NO: 7182 - RNA, 20 nt, Artificial Sequence
  spacer sequence
cgaccugaauaaugcucaau

SEQ ID NO: 7183 - RNA, 20 nt, Artificial Sequence
  spacer sequence
ugauggccucgcaaguuaaa

SEQ ID NO: 7184 - RNA, 20 nt, Artificial Sequence
  spacer sequence
ggucgugauggccucgcaag

SEQ ID NO: 7185 - RNA, 20 nt, Artificial Sequence
  spacer sequence
auguucagcuguucaccuuc

SEQ ID NO: 7186 - RNA, 20 nt, Artificial Sequence
  spacer sequence
gcuguucaccuucuauucau

SEQ ID NO: 7187 - RNA, 20 nt, Artificial Sequence
  spacer sequence
ccuucuauucauuauuucua

SEQ ID NO: 7188 - RNA, 20 nt, Artificial Sequence
  spacer sequence
auucauuauuucuauucauu

SEQ ID NO: 7189 - RNA, 20 nt, Artificial Sequence
  spacer sequence
uuauuucuauucauucuucc

SEQ ID NO: 7190 - RNA, 20 nt, Artificial Sequence
  spacer sequence
auucauucuuccaaaggugg

SEQ ID NO: 7191 - RNA, 20 nt, Artificial Sequence
  spacer sequence
uucuuccaaagguggcaagu

SEQ ID NO: 7192 - RNA, 20 nt, Artificial Sequence
  spacer sequence
uccaaagguggcaagucugg

SEQ ID NO: 7193 - RNA, 20 nt, Artificial Sequence
  spacer sequence
aaagguggcaagucugguaa

SEQ ID NO: 7194 - RNA, 20 nt, Artificial Sequence
  spacer sequence
gguaagguuggugcugcuga

SEQ ID NO: 7195 - RNA, 20 nt, Artificial Sequence
  spacer sequence
gcagcaccaaccuuaccaga

SEQ ID NO: 7196 - RNA, 20 nt, Artificial Sequence
  spacer sequence
uuguuauuucagcagcacca

SEQ ID NO: 7197 - RNA, 20 nt, Artificial Sequence
  spacer sequence
ugguuuuauuuuccuaucua

SEQ ID NO: 7198 - RNA, 20 nt, Artificial Sequence
  spacer sequence
uaucuacaugaggguuugcu

SEQ ID NO: 7199 - RNA, 20 nt, Artificial Sequence
  spacer sequence
acaugaggguuugcucauac

SEQ ID NO: 7200 - RNA, 20 nt, Artificial Sequence
  spacer sequence
uguagauaggaaaauaaaac

SEQ ID NO: 7201 - RNA, 20 nt, Artificial Sequence
  spacer sequence
uacugauauaagagucacgc

SEQ ID NO: 7202 - RNA, 20 nt, Artificial Sequence
  spacer sequence
guaugagcaaacccucaugu

SEQ ID NO: 7203 - RNA, 20 nt, Artificial Sequence
  spacer sequence
uauaucaguaugagcaaacc

SEQ ID NO: 7204 - RNA, 20 nt, Artificial Sequence
  spacer sequence
cgcaaguucaacaaccuguc

SEQ ID NO: 7205 - RNA, 20 nt, Artificial Sequence
  spacer sequence
acaaccugucauuuucugcu

SEQ ID NO: 7206 - RNA, 20 nt, Artificial Sequence
  spacer sequence
uuuucugcuugggguucacc

SEQ ID NO: 7207 - RNA, 20 nt, Artificial Sequence
  spacer sequence
gcuugggguucaccacuuag

SEQ ID NO: 7208 - RNA, 20 nt, Artificial Sequence
  spacer sequence
ccacuuagguacagaaaagc

SEQ ID NO: 7209 - RNA, 20 nt, Artificial Sequence
  spacer sequence
guaccuaaguggugaacccc

SEQ ID NO: 7210 - RNA, 20 nt, Artificial Sequence
  spacer sequence
aaugcuuuucuguaccuaag

SEQ ID NO: 7211 - RNA, 20 nt, Artificial Sequence
  spacer sequence
cucaauuuauccuuuugcaa

SEQ ID NO: 7212 - RNA, 20 nt, Artificial Sequence
  spacer sequence
caauuuauccuuuugcaaau

SEQ ID NO: 7213 - RNA, 20 nt, Artificial Sequence
  spacer sequence
auuuauccuuuugcaaauau

SEQ ID NO: 7214 - RNA, 20 nt, Artificial Sequence
  spacer sequence
uuuugcaaauauaaauaaga

SEQ ID NO: 7215 - RNA, 20 nt, Artificial Sequence
  spacer sequence
uauuuauauuugcaaaagga

SEQ ID NO: 7216 - RNA, 20 nt, Artificial Sequence
  spacer sequence
uaguauuauaguauuugucu

SEQ ID NO: 7217 - RNA, 20 nt, Artificial Sequence
  spacer sequence
aucauaguauuauaguauuu

SEQ ID NO: 7218 - RNA, 20 nt, Artificial Sequence
  spacer sequence
uuucaaucauaguauuauag

SEQ ID NO: 7219 - RNA, 20 nt, Artificial Sequence
  spacer sequence
gauaauggaaaauguuccag

SEQ ID NO: 7220 - RNA, 20 nt, Artificial Sequence
  spacer sequence
gaauaacuccuuucaaucau

SEQ ID NO: 7221 - RNA, 20 nt, Artificial Sequence
  spacer sequence
auuaucagaauaacuccuuu

SEQ ID NO: 7222 - RNA, 20 nt, Artificial Sequence
  spacer sequence
agguacuguuaagaacaugc

SEQ ID NO: 7223 - RNA, 20 nt, Artificial Sequence
  spacer sequence
uaacaguaccuggaacauuu

SEQ ID NO: 7224 - RNA, 20 nt, Artificial Sequence
  spacer sequence
gcagcacauggguaaauagc

SEQ ID NO: 7225 - RNA, 20 nt, Artificial Sequence
  spacer sequence
uugagcaaguuauggguuau

SEQ ID NO: 7226 - RNA, 20 nt, Artificial Sequence
  spacer sequence
aagaccuuucugcagcacau

SEQ ID NO: 7227 - RNA, 20 nt, Artificial Sequence
  spacer sequence
uaacccauaacuugcucaaa

SEQ ID NO: 7228 - RNA, 20 nt, Artificial Sequence
  spacer sequence
guuagcaaugguaagaaaaa

SEQ ID NO: 7229 - RNA, 20 nt, Artificial Sequence
  spacer sequence
uaccauugcuaacugaucau

SEQ ID NO: 7230 - RNA, 20 nt, Artificial Sequence
  spacer sequence
cccaaguauuuuucuuacca

SEQ ID NO: 7231 - RNA, 20 nt, Artificial Sequence
  spacer sequence
gugucacccaaguauuuuuc

SEQ ID NO: 7232 - RNA, 20 nt, Artificial Sequence
  spacer sequence
gucagugucacccaaguauu

SEQ ID NO: 7233 - RNA, 20 nt, Artificial Sequence
  spacer sequence
uuuuucugucagugucaccc

SEQ ID NO: 7234 - RNA, 20 nt, Artificial Sequence
  spacer sequence
caauuggucauuuuucuguc

SEQ ID NO: 7235 - RNA, 20 nt, Artificial Sequence
  spacer sequence
gcauuucccaauuggucauu

SEQ ID NO: 7236 - RNA, 20 nt, Artificial Sequence
  spacer sequence
ggcgcuuuugcugugguaau

SEQ ID NO: 7237 - RNA, 20 nt, Artificial Sequence
  spacer sequence
caauuucuggcgcuuuugcu

SEQ ID NO: 7238 - RNA, 20 nt, Artificial Sequence
  spacer sequence
auuucacaauuucuggcgcu

SEQ ID NO: 7239 - RNA, 20 nt, Artificial Sequence
  spacer sequence
uccauuucacaauuucuggc

SEQ ID NO: 7240 - RNA, 20 nt, Artificial Sequence
  spacer sequence
ccucauccauuucacaauuu

SEQ ID NO: 7241 - RNA, 20 nt, Artificial Sequence
  spacer sequence
gucccuucacaggcucuuca

SEQ ID NO: 7242 - RNA, 20 nt, Artificial Sequence
  spacer sequence
cuucacaggcucuucagaca

SEQ ID NO: 7243 - RNA, 20 nt, Artificial Sequence
  spacer sequence
caggcucuucagacacuuug

SEQ ID NO: 7244 - RNA, 20 nt, Artificial Sequence
  spacer sequence
ucagacacuuugggaaaauc

SEQ ID NO: 7245 - RNA, 20 nt, Artificial Sequence
  spacer sequence
gacacuuugggaaaauccca

SEQ ID NO: 7246 - RNA, 20 nt, Artificial Sequence
  spacer sequence
gaagagccugugaagggaca

SEQ ID NO: 7247 - RNA, 20 nt, Artificial Sequence
  spacer sequence
caaagugucugaagagccug

SEQ ID NO: 7248 - RNA, 20 nt, Artificial Sequence
  spacer sequence
caaugaacaaguacaggaca

SEQ ID NO: 7249 - RNA, 20 nt, Artificial Sequence
  spacer sequence
uugggauuuucccaaagugu

SEQ ID NO: 7250 - RNA, 20 nt, Artificial Sequence
  spacer sequence
uguacuuguucauugggauu

SEQ ID NO: 7251 - RNA, 20 nt, Artificial Sequence
  spacer sequence
cagauagaaauaaaacacuc

SEQ ID NO: 7252 - RNA, 20 nt, Artificial Sequence
  spacer sequence
gauagaaauaaaacacucuu

SEQ ID NO: 7253 - RNA, 20 nt, Artificial Sequence
  spacer sequence
gagauacaguguagcuggug

SEQ ID NO: 7254 - RNA, 20 nt, Artificial Sequence
  spacer sequence
aucugagauacaguguagcu

SEQ ID NO: 7255 - RNA, 20 nt, Artificial Sequence
  spacer sequence
ucacaucauuugggaaauau

SEQ ID NO: 7256 - RNA, 20 nt, Artificial Sequence
  spacer sequence
caucauuugggaaauauuua

SEQ ID NO: 7257 - RNA, 20 nt, Artificial Sequence
  spacer sequence
uuugggaaauauuuaccgag

SEQ ID NO: 7258 - RNA, 20 nt, Artificial Sequence
  spacer sequence
caaaugaugugaagaguguu

SEQ ID NO: 7259 - RNA, 20 nt, Artificial Sequence
  spacer sequence
guaaauauuucccaaaugau

SEQ ID NO: 7260 - RNA, 20 nt, Artificial Sequence
  spacer sequence
guugccccaguguaugguau

SEQ ID NO: 7261 - RNA, 20 nt, Artificial Sequence
  spacer sequence
uugcuuucacuuuguaaaga

SEQ ID NO: 7262 - RNA, 20 nt, Artificial Sequence
  spacer sequence
cuuuguaaagaaauagugua

SEQ ID NO: 7263 - RNA, 20 nt, Artificial Sequence
  spacer sequence
uuacaaagugaaagcaagga

SEQ ID NO: 7264 - RNA, 20 nt, Artificial Sequence
  spacer sequence
aacaccuguggacuuuaauc

SEQ ID NO: 7265 - RNA, 20 nt, Artificial Sequence
  spacer sequence
acagguguuggaacuacacu

SEQ ID NO: 7266 - RNA, 20 nt, Artificial Sequence
  spacer sequence
aaaacauaaaauguauaugc

SEQ ID NO: 7267 - RNA, 20 nt, Artificial Sequence
  spacer sequence
cuuuuaauagagggaucauu

SEQ ID NO: 7268 - RNA, 20 nt, Artificial Sequence
  spacer sequence
uuuaauagagggaucauuau

SEQ ID NO: 7269 - RNA, 20 nt, Artificial Sequence
  spacer sequence
auuaaaagagacugugccug

SEQ ID NO: 7270 - RNA, 20 nt, Artificial Sequence
  spacer sequence
cucuauuaaaagagacugug

SEQ ID NO: 7271 - RNA, 20 nt, Artificial Sequence
  spacer sequence
uuauauagaaacaccugaaa

SEQ ID NO: 7272 - RNA, 20 nt, Artificial Sequence
  spacer sequence
auauaaugaucccucuauua

SEQ ID NO: 7273 - RNA, 20 nt, Artificial Sequence
  spacer sequence
gguguuucuauauaaugauc

SEQ ID NO: 7274 - RNA, 20 nt, Artificial Sequence
  spacer sequence
guuuguuucagguguuucua

SEQ ID NO: 7275 - RNA, 20 nt, Artificial Sequence
  spacer sequence
cauuaccuuuuaucaguaaa

SEQ ID NO: 7276 - RNA, 20 nt, Artificial Sequence
  spacer sequence
guaaagauuuguuuuccagg

SEQ ID NO: 7277 - RNA, 20 nt, Artificial Sequence
  spacer sequence
uuacugauaaaagguaaugg

SEQ ID NO: 7278 - RNA, 20 nt, Artificial Sequence
  spacer sequence
aggacuaaaaugaccaaugu

SEQ ID NO: 7279 - RNA, 20 nt, Artificial Sequence
  spacer sequence
uggaaaacaaaucuuuacug

SEQ ID NO: 7280 - RNA, 20 nt, Artificial Sequence
  spacer sequence
uuuuaguccuggaaaacaaa

SEQ ID NO: 7281 - RNA, 20 nt, Artificial Sequence
  spacer sequence
guuaacaguaaacauugguc

SEQ ID NO: 7282 - RNA, 20 nt, Artificial Sequence
  spacer sequence
gcauagaacauucuggugcc

SEQ ID NO: 7283 - RNA, 20 nt, Artificial Sequence
  spacer sequence
augcugaccuccguuaacag

SEQ ID NO: 7284 - RNA, 20 nt, Artificial Sequence
  spacer sequence
ggugccuaucuauagguuca

SEQ ID NO: 7285 - RNA, 20 nt, Artificial Sequence
  spacer sequence
auagguucaaguggccaagc

SEQ ID NO: 7286 - RNA, 20 nt, Artificial Sequence
  spacer sequence
aguggccaagccaaauuaua

SEQ ID NO: 7287 - RNA, 20 nt, Artificial Sequence
  spacer sequence
gguguuauauuauaauuugg

SEQ ID NO: 7288 - RNA, 20 nt, Artificial Sequence
  spacer sequence
cccguuuuucugguguuaua

SEQ ID NO: 7289 - RNA, 20 nt, Artificial Sequence
  spacer sequence
aagcaucuuauuauaacaag

SEQ ID NO: 7290 - RNA, 20 nt, Artificial Sequence
  spacer sequence
uauuauaacaagagaauuua

SEQ ID NO: 7291 - RNA, 20 nt, Artificial Sequence
  spacer sequence
uguuauaauaagaugcuuug

SEQ ID NO: 7292 - RNA, 20 nt, Artificial Sequence
  spacer sequence
cuuguuauaauaagaugcuu

SEQ ID NO: 7293 - RNA, 20 nt, Artificial Sequence
  spacer sequence
acuaaauucucuuguuauaa

SEQ ID NO: 7294 - RNA, 20 nt, Artificial Sequence
  spacer sequence
caacuaaauucucuuguuau

SEQ ID NO: 7295 - RNA, 20 nt, Artificial Sequence
  spacer sequence
ucucaacuaaauucucuugu

SEQ ID NO: 7296 - RNA, 20 nt, Artificial Sequence
  spacer sequence
ucaaaaggaaagugauuccu

SEQ ID NO: 7297 - RNA, 20 nt, Artificial Sequence
  spacer sequence
aaaggaaagugauuccugaa

SEQ ID NO: 7298 - RNA, 20 nt, Artificial Sequence
  spacer sequence
uuuugaagacucaucucaac

SEQ ID NO: 7299 - RNA, 20 nt, Artificial Sequence
  spacer sequence
cuuuccuuuugaagacucau

SEQ ID NO: 7300 - RNA, 20 nt, Artificial Sequence
  spacer sequence
ugaagggcaaugggaagguc

SEQ ID NO: 7301 - RNA, 20 nt, Artificial Sequence
  spacer sequence
ggaaucacuuuccuuuugaa

SEQ ID NO: 7302 - RNA, 20 nt, Artificial Sequence
  spacer sequence
cauugcccuucaggaaucac

SEQ ID NO: 7303 - RNA, 20 nt, Artificial Sequence
  spacer sequence
uacuccugaugccccauuga

SEQ ID NO: 7304 - RNA, 20 nt, Artificial Sequence
  spacer sequence
ugaugccccauugacuuggc

SEQ ID NO: 7305 - RNA, 20 nt, Artificial Sequence
  spacer sequence
ggaguaggaccuucccauug

SEQ ID NO: 7306 - RNA, 20 nt, Artificial Sequence
  spacer sequence
auggggcaucaggaguagga

SEQ ID NO: 7307 - RNA, 20 nt, Artificial Sequence
  spacer sequence
ucaaguaucugacaguggcc

SEQ ID NO: 7308 - RNA, 20 nt, Artificial Sequence
  spacer sequence
aguaucugacaguggccaaa

SEQ ID NO: 7309 - RNA, 20 nt, Artificial Sequence
  spacer sequence
gacaguggccaaaggaugca

SEQ ID NO: 7310 - RNA, 20 nt, Artificial Sequence
  spacer sequence
gauacuugaggaagccaagu

SEQ ID NO: 7311 - RNA, 20 nt, Artificial Sequence
  spacer sequence
uuuggccacugucagauacu

SEQ ID NO: 7312 - RNA, 20 nt, Artificial Sequence
  spacer sequence
acuuuguacagaagagagaa

SEQ ID NO: 7313 - RNA, 20 nt, Artificial Sequence
  spacer sequence
guacaaaguugagguggcuu

SEQ ID NO: 7314 - RNA, 20 nt, Artificial Sequence
  spacer sequence
ucuguacaaaguugaggugg

SEQ ID NO: 7315 - RNA, 20 nt, Artificial Sequence
  spacer sequence
cuucuguacaaaguugaggu

SEQ ID NO: 7316 - RNA, 20 nt, Artificial Sequence
  spacer sequence
cucuucuguacaaaguugag

SEQ ID NO: 7317 - RNA, 20 nt, Artificial Sequence
  spacer sequence
gggcccauuuucucucuucu

SEQ ID NO: 7318 - RNA, 20 nt, Artificial Sequence
  spacer sequence
ucagggcccauuuucucucu

SEQ ID NO: 7319 - RNA, 20 nt, Artificial Sequence
  spacer sequence
gggguuuguauuuuaucauc

SEQ ID NO: 7320 - RNA, 20 nt, Artificial Sequence
  spacer sequence
gucugggguuuguauuuuau

SEQ ID NO: 7321 - RNA, 20 nt, Artificial Sequence
  spacer sequence
uucagucugggguuuguauu

SEQ ID NO: 7322 - RNA, 20 nt, Artificial Sequence
  spacer sequence
cuuaaguacuuuacagcauu

SEQ ID NO: 7323 - RNA, 20 nt, Artificial Sequence
  spacer sequence
uaaguacuuuacagcauuca

SEQ ID NO: 7324 - RNA, 20 nt, Artificial Sequence
  spacer sequence
uuugaggguauaaauuaaca

SEQ ID NO: 7325 - RNA, 20 nt, Artificial Sequence
  spacer sequence
aaugaaugcuguaaaguacu

SEQ ID NO: 7326 - RNA, 20 nt, Artificial Sequence
  spacer sequence
uauaaaccuuauauaaaagc

SEQ ID NO: 7327 - RNA, 20 nt, Artificial Sequence
  spacer sequence
uuauaaaaauugugcuuuua

SEQ ID NO: 7328 - RNA, 20 nt, Artificial Sequence
  spacer sequence
aacaaguaggcaauucuuua

SEQ ID NO: 7329 - RNA, 20 nt, Artificial Sequence
  spacer sequence
acauguaucaaacaaguagg

SEQ ID NO: 7330 - RNA, 20 nt, Artificial Sequence
  spacer sequence
cacacacaaauauccacaug

SEQ ID NO: 7331 - RNA, 20 nt, Artificial Sequence
  spacer sequence
aauccuuucccuucuucgua

SEQ ID NO: 7332 - RNA, 20 nt, Artificial Sequence
  spacer sequence
uuucccuucuucguaaauaa

SEQ ID NO: 7333 - RNA, 20 nt, Artificial Sequence
  spacer sequence
cuucuucguaaauaaagcua

SEQ ID NO: 7334 - RNA, 20 nt, Artificial Sequence
  spacer sequence
ucguaaauaaagcuaaaaag

SEQ ID NO: 7335 - RNA, 20 nt, Artificial Sequence
  spacer sequence
uaaauaaagcuaaaaagaug

SEQ ID NO: 7336 - RNA, 20 nt, Artificial Sequence
  spacer sequence
uuuuagcuuuauuuacgaag

SEQ ID NO: 7337 - RNA, 20 nt, Artificial Sequence
  spacer sequence
uuuuaacccuuugagagcca

SEQ ID NO: 7338 - RNA, 20 nt, Artificial Sequence
  spacer sequence
aaggguuaaaaggaaaccca

SEQ ID NO: 7339 - RNA, 20 nt, Artificial Sequence
  spacer sequence
caaaggguuaaaaggaaacc

SEQ ID NO: 7340 - RNA, 20 nt, Artificial Sequence
  spacer sequence
auaaauuuaguuggcucuca

SEQ ID NO: 7341 - RNA, 20 nt, Artificial Sequence
  spacer sequence
ugauagaauaugcccauagc

SEQ ID NO: 7342 - RNA, 20 nt, Artificial Sequence
  spacer sequence
ggaaucuauaaauuuaguug

SEQ ID NO: 7343 - RNA, 20 nt, Artificial Sequence
  spacer sequence
aucaggaaucuauaaauuua

SEQ ID NO: 7344 - RNA, 20 nt, Artificial Sequence
  spacer sequence
ggggcuaugggcauauucua

SEQ ID NO: 7345 - RNA, 20 nt, Artificial Sequence
  spacer sequence
gaccacaaaaaaaauuuuau

SEQ ID NO: 7346 - RNA, 20 nt, Artificial Sequence
  spacer sequence
gaaggccaucuggggcuaug

SEQ ID NO: 7347 - RNA, 20 nt, Artificial Sequence
  spacer sequence
guaguuccuuuuauucccuu

SEQ ID NO: 7348 - RNA, 20 nt, Artificial Sequence
  spacer sequence
uuuuauucccuuuugcagug

SEQ ID NO: 7349 - RNA, 20 nt, Artificial Sequence
  spacer sequence
cuuuugcagugaacauguaa

SEQ ID NO: 7350 - RNA, 20 nt, Artificial Sequence
  spacer sequence
cugcaaaagggaauaaaagg

SEQ ID NO: 7351 - RNA, 20 nt, Artificial Sequence
  spacer sequence
gccaccuaauguguuuuuaa

SEQ ID NO: 7352 - RNA, 20 nt, Artificial Sequence
  spacer sequence
ucugccaccuaauguguuuu

SEQ ID NO: 7353 - RNA, 20 nt, Artificial Sequence
  spacer sequence
uagcuagcaugcuugccagu

SEQ ID NO: 7354 - RNA, 20 nt, Artificial Sequence
  spacer sequence
uuauuaggaaagcuggcauu

SEQ ID NO: 7355 - RNA, 20 nt, Artificial Sequence
  spacer sequence
uaauaaggacuuccuagcua

SEQ ID NO: 7356 - RNA, 20 nt, Artificial Sequence
  spacer sequence
guauauugugaguuacccag

SEQ ID NO: 7357 - RNA, 20 nt, Artificial Sequence
  spacer sequence
caauauacugaugguuuaug

SEQ ID NO: 7358 - RNA, 20 nt, Artificial Sequence
  spacer sequence
ccuggguaacucacaauaua

SEQ ID NO: 7359 - RNA, 20 nt, Artificial Sequence
  spacer sequence
aagcaauuguucauuucauu

SEQ ID NO: 7360 - RNA, 20 nt, Artificial Sequence
  spacer sequence
uuucauuuggaaauaugacg

SEQ ID NO: 7361 - RNA, 20 nt, Artificial Sequence
  spacer sequence
uuuggaaauaugacguguga

SEQ ID NO: 7362 - RNA, 20 nt, Artificial Sequence
  spacer sequence
aaaugaaaugaacaauugcu

SEQ ID NO: 7363 - RNA, 20 nt, Artificial Sequence
  spacer sequence
uauuuccaaaugaaaugaac

SEQ ID NO: 7364 - RNA, 20 nt, Artificial Sequence
  spacer sequence
cacgucauauuuccaaauga

SEQ ID NO: 7365 - RNA, 20 nt, Artificial Sequence
  spacer sequence
cugaugaguuuucuaaaguu

SEQ ID NO: 7366 - RNA, 20 nt, Artificial Sequence
  spacer sequence
gugauaucacacgucauauu

SEQ ID NO: 7367 - RNA, 20 nt, Artificial Sequence
  spacer sequence
ucagugauaucacacgucau

SEQ ID NO: 7368 - RNA, 20 nt, Artificial Sequence
  spacer sequence
aaaguuauaaauuuuuaaaa

SEQ ID NO: 7369 - RNA, 20 nt, Artificial Sequence
  spacer sequence
uucauauuauguauuaaaua

SEQ ID NO: 7370 - RNA, 20 nt, Artificial Sequence
  spacer sequence
uauuauguauuaaauaucug

SEQ ID NO: 7371 - RNA, 20 nt, Artificial Sequence
  spacer sequence
gaauuuucuauuaacucauu

SEQ ID NO: 7372 - RNA, 20 nt, Artificial Sequence
  spacer sequence
gauauuuaauacauaauaug

SEQ ID NO: 7373 - RNA, 20 nt, Artificial Sequence
  spacer sequence
auuaacucauuuaauagucc

SEQ ID NO: 7374 - RNA, 20 nt, Artificial Sequence
  spacer sequence
uuuaauaguccuuuccuuca

SEQ ID NO: 7375 - RNA, 20 nt, Artificial Sequence
  spacer sequence
uuuccuucaaaagggacagu

SEQ ID NO: 7376 - RNA, 20 nt, Artificial Sequence
  spacer sequence
uucaaaagggacaguuuggu

SEQ ID NO: 7377 - RNA, 20 nt, Artificial Sequence
  spacer sequence
aaagggacaguuugguagaa

SEQ ID NO: 7378 - RNA, 20 nt, Artificial Sequence
  spacer sequence
cuuuugaaggaaaggacuau

SEQ ID NO: 7379 - RNA, 20 nt, Artificial Sequence
  spacer sequence
accaaacugucccuuuugaa

SEQ ID NO: 7380 - RNA, 20 nt, Artificial Sequence
  spacer sequence
auuucuaccaaacugucccu

SEQ ID NO: 7381 - RNA, 20 nt, Artificial Sequence
  spacer sequence
auugcuguaggagauggcac

SEQ ID NO: 7382 - RNA, 20 nt, Artificial Sequence
  spacer sequence
uacagcaauugaaauuuguc

SEQ ID NO: 7383 - RNA, 20 nt, Artificial Sequence
  spacer sequence
ccuacagcaauugaaauuug

SEQ ID NO: 7384 - RNA, 20 nt, Artificial Sequence
  spacer sequence
auaccaccaugcuagcuugu

SEQ ID NO: 7385 - RNA, 20 nt, Artificial Sequence
  spacer sequence
caccucuauaccaccaugcu

SEQ ID NO: 7386 - RNA, 20 nt, Artificial Sequence
  spacer sequence
uaaagcuggugugugaaucu

SEQ ID NO: 7387 - RNA, 20 nt, Artificial Sequence
  spacer sequence
cacaccagcuuuaugagucc

SEQ ID NO: 7388 - RNA, 20 nt, Artificial Sequence
  spacer sequence
gaguggcagucaucgggggu

SEQ ID NO: 7389 - RNA, 20 nt, Artificial Sequence
  spacer sequence
gauucacacaccagcuuuau

SEQ ID NO: 7390 - RNA, 20 nt, Artificial Sequence
  spacer sequence
ucgggggugucugaauugga

SEQ ID NO: 7391 - RNA, 20 nt, Artificial Sequence
  spacer sequence
ggggugucugaauuggaucu

SEQ ID NO: 7392 - RNA, 20 nt, Artificial Sequence
  spacer sequence
gaauuggaucucaaaggaaa

SEQ ID NO: 7393 - RNA, 20 nt, Artificial Sequence
  spacer sequence
gacacccccgaugacugcca

SEQ ID NO: 7394 - RNA, 20 nt, Artificial Sequence
  spacer sequence
aauucagacacccccgauga

SEQ ID NO: 7395 - RNA, 20 nt, Artificial Sequence
  spacer sequence
caaaggaaaaugcacaaggc

SEQ ID NO: 7396 - RNA, 20 nt, Artificial Sequence
  spacer sequence
aaggaaaaugcacaaggcca

SEQ ID NO: 7397 - RNA, 20 nt, Artificial Sequence
  spacer sequence
uuugagauccaauucagaca

SEQ ID NO: 7398 - RNA, 20 nt, Artificial Sequence
  spacer sequence
cuggccuugugcauuuuccu

SEQ ID NO: 7399 - RNA, 20 nt, Artificial Sequence
  spacer sequence
uuaacucacuggccuugugc

SEQ ID NO: 7400 - RNA, 20 nt, Artificial Sequence
  spacer sequence
uuccuuaacucacuggccuu

SEQ ID NO: 7401 - RNA, 20 nt, Artificial Sequence
  spacer sequence
agacauuacuagcagcuuuu

SEQ ID NO: 7402 - RNA, 20 nt, Artificial Sequence
  spacer sequence
ugauaguaacguccuuccuu

SEQ ID NO: 7403 - RNA, 20 nt, Artificial Sequence
  spacer sequence
aaagcugcuaguaaugucuu

SEQ ID NO: 7404 - RNA, 20 nt, Artificial Sequence
  spacer sequence
gagaaccacaauaaaaugac

SEQ ID NO: 7405 - RNA, 20 nt, Artificial Sequence
  spacer sequence
gaaccacacacaccacugcu

SEQ ID NO: 7406 - RNA, 20 nt, Artificial Sequence
  spacer sequence
cugaaccacacacaccacug

SEQ ID NO: 7407 - RNA, 20 nt, Artificial Sequence
  spacer sequence
uuuuauugugguucucugaa

SEQ ID NO: 7408 - RNA, 20 nt, Artificial Sequence
  spacer sequence
agucauuuuauugugguucu

SEQ ID NO: 7409 - RNA, 20 nt, Artificial Sequence
  spacer sequence
ucaagucauuuuauuguggu

SEQ ID NO: 7410 - RNA, 20 nt, Artificial Sequence
  spacer sequence
uaguuuucaucaagucauuu

SEQ ID NO: 7411 - RNA, 20 nt, Artificial Sequence
  spacer sequence
ucuuaguuuucaucaaguca

SEQ ID NO: 7412 - RNA, 20 nt, Artificial Sequence
  spacer sequence
uuucuucuuaguuuucauca

SEQ ID NO: 7413 - RNA, 20 nt, Artificial Sequence
  spacer sequence
ccuuucuucuuaguuuucau

SEQ ID NO: 7414 - RNA, 20 nt, Artificial Sequence
  spacer sequence
guauuuucuccuuucuucuu

SEQ ID NO: 7415 - RNA, 20 nt, Artificial Sequence
  spacer sequence
ucuguauuuucuccuuucuu

SEQ ID NO: 7416 - RNA, 20 nt, Artificial Sequence
  spacer sequence
uaaaccucaucuguauuuuc

SEQ ID NO: 7417 - RNA, 20 nt, Artificial Sequence
  spacer sequence
uuagcuucauaaaccucauc

SEQ ID NO: 7418 - RNA, 20 nt, Artificial Sequence
  spacer sequence
cuuuagcuucauaaaccuca

SEQ ID NO: 7419 - RNA, 20 nt, Artificial Sequence
  spacer sequence
gggcaauucacaggcccuau

SEQ ID NO: 7420 - RNA, 20 nt, Artificial Sequence
  spacer sequence
caggcccuauaugccauaag

SEQ ID NO: 7421 - RNA, 20 nt, Artificial Sequence
  spacer sequence
uuauggcauauagggccugu

SEQ ID NO: 7422 - RNA, 20 nt, Artificial Sequence
  spacer sequence
uccuuauggcauauagggcc

SEQ ID NO: 7423 - RNA, 20 nt, Artificial Sequence
  spacer sequence
agguuccuccuuauggcaua

SEQ ID NO: 7424 - RNA, 20 nt, Artificial Sequence
  spacer sequence
aaguccagguuccuccuuau

SEQ ID NO: 7425 - RNA, 20 nt, Artificial Sequence
  spacer sequence
aguggugcagaaaaccaagu

SEQ ID NO: 7426 - RNA, 20 nt, Artificial Sequence
  spacer sequence
gcaccacuagaggucaaagu

SEQ ID NO: 7427 - RNA, 20 nt, Artificial Sequence
  spacer sequence
cugcuaaaaauuacuugguu

SEQ ID NO: 7428 - RNA, 20 nt, Artificial Sequence
  spacer sequence
uuuaucccugcuaaaaauua

SEQ ID NO: 7429 - RNA, 20 nt, Artificial Sequence
  spacer sequence
augauuguuuuugauagauc

SEQ ID NO: 7430 - RNA, 20 nt, Artificial Sequence
  spacer sequence
uagaaucauuuaucccugcu

SEQ ID NO: 7431 - RNA, 20 nt, Artificial Sequence
  spacer sequence
aaaacaaucauagaaucauu

SEQ ID NO: 7432 - RNA, 20 nt, Artificial Sequence
  spacer sequence
aucaaaaacaaucauagaau

SEQ ID NO: 7433 - RNA, 20 nt, Artificial Sequence
  spacer sequence
uucuggcaaguaguguauag

SEQ ID NO: 7434 - RNA, 20 nt, Artificial Sequence
  spacer sequence
ggcaaguaguguauaggaua

SEQ ID NO: 7435 - RNA, 20 nt, Artificial Sequence
  spacer sequence
uauacacuacuugccagaag

SEQ ID NO: 7436 - RNA, 20 nt, Artificial Sequence
  spacer sequence
uagcuauccuauacacuacu

SEQ ID NO: 7437 - RNA, 20 nt, Artificial Sequence
  spacer sequence
ccucuuagcuauccuauaca

SEQ ID NO: 7438 - RNA, 20 nt, Artificial Sequence
  spacer sequence
agaguaguuaggcacuuauu

SEQ ID NO: 7439 - RNA, 20 nt, Artificial Sequence
  spacer sequence
aggggccuuccccucuuagc

SEQ ID NO: 7440 - RNA, 20 nt, Artificial Sequence
  spacer sequence
cgaggggccuuccccucuua

SEQ ID NO: 7441 - RNA, 20 nt, Artificial Sequence
  spacer sequence
gagaauccagcagugacagu

SEQ ID NO: 7442 - RNA, 20 nt, Artificial Sequence
  spacer sequence
gaauaagugccuaacuacuc

SEQ ID NO: 7443 - RNA, 20 nt, Artificial Sequence
  spacer sequence
ccgaauaagugccuaacuac

SEQ ID NO: 7444 - RNA, 20 nt, Artificial Sequence
  spacer sequence
agcagugacagugauaguga

SEQ ID NO: 7445 - RNA, 20 nt, Artificial Sequence
  spacer sequence
cugcuggauucuccgaauaa

SEQ ID NO: 7446 - RNA, 20 nt, Artificial Sequence
  spacer sequence
cugucacugcuggauucucc

SEQ ID NO: 7447 - RNA, 20 nt, Artificial Sequence
  spacer sequence
cuaucacugucacugcugga

SEQ ID NO: 7448 - RNA, 20 nt, Artificial Sequence
  spacer sequence
ugucacuaucacugucacug

SEQ ID NO: 7449 - RNA, 20 nt, Artificial Sequence
  spacer sequence
cuugucacuaucacugucac

SEQ ID NO: 7450 - RNA, 20 nt, Artificial Sequence
  spacer sequence
gucucuugucacuaucacug

SEQ ID NO: 7451 - RNA, 20 nt, Artificial Sequence
  spacer sequence
cuucagucucuugucacuau

SEQ ID NO: 7452 - RNA, 20 nt, Artificial Sequence
  spacer sequence
cacuucagucucuugucacu

SEQ ID NO: 7453 - RNA, 20 nt, Artificial Sequence
  spacer sequence
agcaccucucacuucagucu

SEQ ID NO: 7454 - RNA, 20 nt, Artificial Sequence
  spacer sequence
cuagcaccucucacuucagu

SEQ ID NO: 7455 - RNA, 20 nt, Artificial Sequence
  spacer sequence
aucucuagcaccucucacuu

SEQ ID NO: 7456 - RNA, 20 nt, Artificial Sequence
  spacer sequence
uccaucucuagcaccucuca

SEQ ID NO: 7457 - RNA, 20 nt, Artificial Sequence
  spacer sequence
guguguccuccaucucuagc

SEQ ID NO: 7458 - RNA, 20 nt, Artificial Sequence
  spacer sequence
ucaguguguccuccaucucu

SEQ ID NO: 7459 - RNA, 20 nt, Artificial Sequence
  spacer sequence
acuaaaugucuucagugugu

SEQ ID NO: 7460 - RNA, 20 nt, Artificial Sequence
  spacer sequence
uguccacuaaaugucuucag

SEQ ID NO: 7461 - RNA, 20 nt, Artificial Sequence
  spacer sequence
uuccuguccacuaaaugucu

SEQ ID NO: 7462 - RNA, 20 nt, Artificial Sequence
  spacer sequence
cuuacacccuguccuuccug

SEQ ID NO: 7463 - RNA, 20 nt, Artificial Sequence
  spacer sequence
uacaucgcuuacacccuguc

SEQ ID NO: 7464 - RNA, 20 nt, Artificial Sequence
  spacer sequence
cugccuuaacugagcggaug

SEQ ID NO: 7465 - RNA, 20 nt, Artificial Sequence
  spacer sequence
gccuuaacugagcggaugca

SEQ ID NO: 7466 - RNA, 20 nt, Artificial Sequence
  spacer sequence
guuaaggcagagagcugugu

SEQ ID NO: 7467 - RNA, 20 nt, Artificial Sequence
  spacer sequence
gcucaguuaaggcagagagc

SEQ ID NO: 7468 - RNA, 20 nt, Artificial Sequence
  spacer sequence
acgcaagaucagaagaguga

SEQ ID NO: 7469 - RNA, 20 nt, Artificial Sequence
  spacer sequence
ugcguugacagcugcauccg

SEQ ID NO: 7470 - RNA, 20 nt, Artificial Sequence
  spacer sequence
gaagagugaugguguuaacu

SEQ ID NO: 7471 - RNA, 20 nt, Artificial Sequence
  spacer sequence
gaucuugcguugacagcugc

SEQ ID NO: 7472 - RNA, 20 nt, Artificial Sequence
  spacer sequence
ucugaucuugcguugacagc

SEQ ID NO: 7473 - RNA, 20 nt, Artificial Sequence
  spacer sequence
cucuucugaucuugcguuga

SEQ ID NO: 7474 - RNA, 20 nt, Artificial Sequence
  spacer sequence
cccggaauauaggugaaaca

SEQ ID NO: 7475 - RNA, 20 nt, Artificial Sequence
  spacer sequence
gggggaguuaacaccaucac

SEQ ID NO: 7476 - RNA, 20 nt, Artificial Sequence
  spacer sequence
ccuauauuccgggggaguua

SEQ ID NO: 7477 - RNA, 20 nt, Artificial Sequence
  spacer sequence
gaccugggaaacaaauuuuu

SEQ ID NO: 7478 - RNA, 20 nt, Artificial Sequence
  spacer sequence
gagcccuuuuuuguuucacc

SEQ ID NO: 7479 - RNA, 20 nt, Artificial Sequence
  spacer sequence
caggucugagcccuuuuuug

SEQ ID NO: 7480 - RNA, 20 nt, Artificial Sequence
  spacer sequence
cuguauuaaaaauuuguuuc

SEQ ID NO: 7481 - RNA, 20 nt, Artificial Sequence
  spacer sequence
gcccuaaugccucgcuguau

SEQ ID NO: 7482 - RNA, 20 nt, Artificial Sequence
  spacer sequence
cuguuuuggucugcccuaau

SEQ ID NO: 7483 - RNA, 20 nt, Artificial Sequence
  spacer sequence
aagugccugaauucaaauuu

SEQ ID NO: 7484 - RNA, 20 nt, Artificial Sequence
  spacer sequence
ggcacuuagagccaucacug

SEQ ID NO: 7485 - RNA, 20 nt, Artificial Sequence
  spacer sequence
aauuugggaaguauggaaaa

SEQ ID NO: 7486 - RNA, 20 nt, Artificial Sequence
  spacer sequence
caaauuugaauucaggcacu

SEQ ID NO: 7487 - RNA, 20 nt, Artificial Sequence
  spacer sequence
auacuucccaaauuugaauu

SEQ ID NO: 7488 - RNA, 20 nt, Artificial Sequence
  spacer sequence
aguguguuuuccauacuucc

SEQ ID NO: 7489 - RNA, 20 nt, Artificial Sequence
  spacer sequence
ugguuauuuuuaguuaaacu

SEQ ID NO: 7490 - RNA, 20 nt, Artificial Sequence
  spacer sequence
guaaauauuuccuaugacga

SEQ ID NO: 7491 - RNA, 20 nt, Artificial Sequence
  spacer sequence
uaugacgauccaaaaaacag

SEQ ID NO: 7492 - RNA, 20 nt, Artificial Sequence
  spacer sequence
uaggaaauauuuacagauuc

SEQ ID NO: 7493 - RNA, 20 nt, Artificial Sequence
  spacer sequence
ucauaggaaauauuuacaga

SEQ ID NO: 7494 - RNA, 20 nt, Artificial Sequence
  spacer sequence
aaaaaacaguugauuuacaa

SEQ ID NO: 7495 - RNA, 20 nt, Artificial Sequence
  spacer sequence
acuguuuuuuggaucgucau

SEQ ID NO: 7496 - RNA, 20 nt, Artificial Sequence
  spacer sequence
ccacccccuuuuguaauugu

SEQ ID NO: 7497 - RNA, 20 nt, Artificial Sequence
  spacer sequence
ccccacccccuuuuguaauu

SEQ ID NO: 7498 - RNA, 20 nt, Artificial Sequence
  spacer sequence
acagcaaagaugccugaaau

SEQ ID NO: 7499 - RNA, 20 nt, Artificial Sequence
  spacer sequence
uugcuguagauggcaauggu

SEQ ID NO: 7500 - RNA, 20 nt, Artificial Sequence
  spacer sequence
ggcaucuuugcuguagaugg

SEQ ID NO: 7501 - RNA, 20 nt, Artificial Sequence
  spacer sequence
caccauuucaggcaucuuug

SEQ ID NO: 7502 - RNA, 20 nt, Artificial Sequence
  spacer sequence
uuauuucacaccauuucagg

SEQ ID NO: 7503 - RNA, 20 nt, Artificial Sequence
  spacer sequence
cccguagcccuuuaauguac

SEQ ID NO: 7504 - RNA, 20 nt, Artificial Sequence
  spacer sequence
caccucccccguagcccuuu

SEQ ID NO: 7505 - RNA, 20 nt, Artificial Sequence
  spacer sequence
cccaccucccccguagcccu

SEQ ID NO: 7506 - RNA, 20 nt, Artificial Sequence
  spacer sequence
uuucucccaccucccccgua

SEQ ID NO: 7507 - RNA, 20 nt, Artificial Sequence
  spacer sequence
accuuccuuucucccaccuc

SEQ ID NO: 7508 - RNA, 20 nt, Artificial Sequence
  spacer sequence
uaguuggaguccaacgugga

SEQ ID NO: 7509 - RNA, 20 nt, Artificial Sequence
  spacer sequence
aacuaugaaaucaaccuucc

SEQ ID NO: 7510 - RNA, 20 nt, Artificial Sequence
  spacer sequence
aacguggaccuugaaaucuc

SEQ ID NO: 7511 - RNA, 20 nt, Artificial Sequence
  spacer sequence
acguuggacuccaacuauga

SEQ ID NO: 7512 - RNA, 20 nt, Artificial Sequence
  spacer sequence
agguccacguuggacuccaa

SEQ ID NO: 7513 - RNA, 20 nt, Artificial Sequence
  spacer sequence
ccggagaaugugcauaaggg

SEQ ID NO: 7514 - RNA, 20 nt, Artificial Sequence
  spacer sequence
ggagaaugugcauaagggau

SEQ ID NO: 7515 - RNA, 20 nt, Artificial Sequence
  spacer sequence
ggagauuucaagguccacgu

SEQ ID NO: 7516 - RNA, 20 nt, Artificial Sequence
  spacer sequence
ccggagauuucaagguccac

SEQ ID NO: 7517 - RNA, 20 nt, Artificial Sequence
  spacer sequence
cuuaugcacauucuccggag

SEQ ID NO: 7518 - RNA, 20 nt, Artificial Sequence
  spacer sequence
uuauaugccuuuuguauccc

SEQ ID NO: 7519 - RNA, 20 nt, Artificial Sequence
  spacer sequence
gucaaggaccacagagugua

SEQ ID NO: 7520 - RNA, 20 nt, Artificial Sequence
  spacer sequence
aggaccacagaguguacgca

SEQ ID NO: 7521 - RNA, 20 nt, Artificial Sequence
  spacer sequence
uugacagaaagccacccuau

SEQ ID NO: 7522 - RNA, 20 nt, Artificial Sequence
  spacer sequence
gugguccuugacagaaagcc

SEQ ID NO: 7523 - RNA, 20 nt, Artificial Sequence
  spacer sequence
gggagacagauauaaaacau

SEQ ID NO: 7524 - RNA, 20 nt, Artificial Sequence
  spacer sequence
cugacugcguacacucugug

SEQ ID NO: 7525 - RNA, 20 nt, Artificial Sequence
  spacer sequence
cccugacugcguacacucug

SEQ ID NO: 7526 - RNA, 20 nt, Artificial Sequence
  spacer sequence
gucucccugacugcguacac

SEQ ID NO: 7527 - RNA, 20 nt, Artificial Sequence
  spacer sequence
gauuuaaauauugugggagu

SEQ ID NO: 7528 - RNA, 20 nt, Artificial Sequence
  spacer sequence
gaccuuuuacauuuuauguu

SEQ ID NO: 7529 - RNA, 20 nt, Artificial Sequence
  spacer sequence
cacaauauuuaaaucagacc

SEQ ID NO: 7530 - RNA, 20 nt, Artificial Sequence
  spacer sequence
cucccacaauauuuaaauca

SEQ ID NO: 7531 - RNA, 20 nt, Artificial Sequence
  spacer sequence
guugcagaggauuuugcaga

SEQ ID NO: 7532 - RNA, 20 nt, Artificial Sequence
  spacer sequence
gcaacugaugcaguugguca

SEQ ID NO: 7533 - RNA, 20 nt, Artificial Sequence
  spacer sequence
ucugcaacugaugcaguugg

SEQ ID NO: 7534 - RNA, 20 nt, Artificial Sequence
  spacer sequence
gcaaaauccucugcaacuga

SEQ ID NO: 7535 - RNA, 20 nt, Artificial Sequence
  spacer sequence
ucugcaaaauccucugcaac

SEQ ID NO: 7536 - RNA, 20 nt, Artificial Sequence
  spacer sequence
gugagaucuuuacagaaaaa

SEQ ID NO: 7537 - RNA, 20 nt, Artificial Sequence
  spacer sequence
cugaaauuuugcauccucug

SEQ ID NO: 7538 - RNA, 20 nt, Artificial Sequence
  spacer sequence
cacugaaauuuugcauccuc

SEQ ID NO: 7539 - RNA, 20 nt, Artificial Sequence
  spacer sequence
uuacagaaaaagaggaacga

SEQ ID NO: 7540 - RNA, 20 nt, Artificial Sequence
  spacer sequence
guaaagaucucacugaaauu

SEQ ID NO: 7541 - RNA, 20 nt, Artificial Sequence
  spacer sequence
uuuucuguaaagaucucacu

SEQ ID NO: 7542 - RNA, 20 nt, Artificial Sequence
  spacer sequence
ucuuuuucuguaaagaucuc

SEQ ID NO: 7543 - RNA, 20 nt, Artificial Sequence
  spacer sequence
uuccucuuuuucuguaaaga

SEQ ID NO: 7544 - RNA, 20 nt, Artificial Sequence
  spacer sequence
guuccucuaccuguuuuggu

SEQ ID NO: 7545 - RNA, 20 nt, Artificial Sequence
  spacer sequence
ucuaccuguuuuggucaaca

SEQ ID NO: 7546 - RNA, 20 nt, Artificial Sequence
  spacer sequence
accuguuuuggucaacaacc

SEQ ID NO: 7547 - RNA, 20 nt, Artificial Sequence
  spacer sequence
acaacccuaucuuccauucu

SEQ ID NO: 7548 - RNA, 20 nt, Artificial Sequence
  spacer sequence
uccauucuaccagagccacc

SEQ ID NO: 7549 - RNA, 20 nt, Artificial Sequence
  spacer sequence
auucuaccagagccaccauc

SEQ ID NO: 7550 - RNA, 20 nt, Artificial Sequence
  spacer sequence
accagagccaccaucucuag

SEQ ID NO: 7551 - RNA, 20 nt, Artificial Sequence
  spacer sequence
gguagaauggaagauagggu

SEQ ID NO: 7552 - RNA, 20 nt, Artificial Sequence
  spacer sequence
cuaggagcucuagauguuug

SEQ ID NO: 7553 - RNA, 20 nt, Artificial Sequence
  spacer sequence
aggagcucuagauguuugau

SEQ ID NO: 7554 - RNA, 20 nt, Artificial Sequence
  spacer sequence
uagagaugguggcucuggua

SEQ ID NO: 7555 - RNA, 20 nt, Artificial Sequence
  spacer sequence
agauguuugaucacuaauaa

SEQ ID NO: 7556 - RNA, 20 nt, Artificial Sequence
  spacer sequence
agagcuccuagagauggugg

SEQ ID NO: 7557 - RNA, 20 nt, Artificial Sequence
  spacer sequence
aacaucuagagcuccuagag

SEQ ID NO: 7558 - RNA, 20 nt, Artificial Sequence
  spacer sequence
cuaauaaagucauuacuucc

SEQ ID NO: 7559 - RNA, 20 nt, Artificial Sequence
  spacer sequence
uuacuuccaaauucccaauu

SEQ ID NO: 7560 - RNA, 20 nt, Artificial Sequence
  spacer sequence
aaauucccaauuucaaguac

SEQ ID NO: 7561 - RNA, 20 nt, Artificial Sequence
  spacer sequence
caauuucaaguaccccacuc

SEQ ID NO: 7562 - RNA, 20 nt, Artificial Sequence
  spacer sequence
aguaccccacucuuuaccug

SEQ ID NO: 7563 - RNA, 20 nt, Artificial Sequence
  spacer sequence
uuaccugcuucuccucuuuc

SEQ ID NO: 7564 - RNA, 20 nt, Artificial Sequence
  spacer sequence
ccucuuuccagguuauucuc

SEQ ID NO: 7565 - RNA, 20 nt, Artificial Sequence
  spacer sequence
ucuuuccagguuauucucuc

SEQ ID NO: 7566 - RNA, 20 nt, Artificial Sequence
  spacer sequence
uuccagguuauucucuccag

SEQ ID NO: 7567 - RNA, 20 nt, Artificial Sequence
  spacer sequence
agguuauucucuccagaucu

SEQ ID NO: 7568 - RNA, 20 nt, Artificial Sequence
  spacer sequence
cuccagaucuccuuucccca

SEQ ID NO: 7569 - RNA, 20 nt, Artificial Sequence
  spacer sequence
ccagaucuccuuuccccaaa

SEQ ID NO: 7570 - RNA, 20 nt, Artificial Sequence
  spacer sequence
agaucuccuuuccccaaaca

SEQ ID NO: 7571 - RNA, 20 nt, Artificial Sequence
  spacer sequence
ggagagaauaaccuggaaag

SEQ ID NO: 7572 - RNA, 20 nt, Artificial Sequence
  spacer sequence
ccuuuccccaaacaaucuuc

SEQ ID NO: 7573 - RNA, 20 nt, Artificial Sequence
  spacer sequence
uuuccccaaacaaucuucaa

SEQ ID NO: 7574 - RNA, 20 nt, Artificial Sequence
  spacer sequence
ccaaacaaucuucaauccca

SEQ ID NO: 7575 - RNA, 20 nt, Artificial Sequence
  spacer sequence
ucaaucccaccaggcucaug

SEQ ID NO: 7576 - RNA, 20 nt, Artificial Sequence
  spacer sequence
aucccaccaggcucaugccu

SEQ ID NO: 7577 - RNA, 20 nt, Artificial Sequence
  spacer sequence
caccaggcucaugccucaca

SEQ ID NO: 7578 - RNA, 20 nt, Artificial Sequence
  spacer sequence
ugccucacaaggcccuucau

SEQ ID NO: 7579 - RNA, 20 nt, Artificial Sequence
  spacer sequence
caaggcccuucauguuuuua

SEQ ID NO: 7580 - RNA, 20 nt, Artificial Sequence
  spacer sequence
uguuuuuaucuuaauccuua

SEQ ID NO: 7581 - RNA, 20 nt, Artificial Sequence
  spacer sequence
uaauccuuaccugcucugga

SEQ ID NO: 7582 - RNA, 20 nt, Artificial Sequence
  spacer sequence
uuaccugcucuggaguccau

SEQ ID NO: 7583 - RNA, 20 nt, Artificial Sequence
  spacer sequence
ggaguccauggcucucccuc

SEQ ID NO: 7584 - RNA, 20 nt, Artificial Sequence
  spacer sequence
agagcagguaaggauuaaga

SEQ ID NO: 7585 - RNA, 20 nt, Artificial Sequence
  spacer sequence
auggcucucccucaccauau

SEQ ID NO: 7586 - RNA, 20 nt, Artificial Sequence
  spacer sequence
cccucaccauaucugccugg

SEQ ID NO: 7587 - RNA, 20 nt, Artificial Sequence
  spacer sequence
cucaccauaucugccuggaa

SEQ ID NO: 7588 - RNA, 20 nt, Artificial Sequence
  spacer sequence
ccauaucugccuggaaaauc

SEQ ID NO: 7589 - RNA, 20 nt, Artificial Sequence
  spacer sequence
gccuggaaaauccccaacau

SEQ ID NO: 7590 - RNA, 20 nt, Artificial Sequence
  spacer sequence
aggcagauauggugagggag

SEQ ID NO: 7591 - RNA, 20 nt, Artificial Sequence
  spacer sequence
ccaacauugguuuuaaaugc

SEQ ID NO: 7592 - RNA, 20 nt, Artificial Sequence
  spacer sequence
ucugccuaaucuccaccugg

SEQ ID NO: 7593 - RNA, 20 nt, Artificial Sequence
  spacer sequence
gccuaaucuccaccuggaca

SEQ ID NO: 7594 - RNA, 20 nt, Artificial Sequence
  spacer sequence
ccaccuggacauggaguaug

SEQ ID NO: 7595 - RNA, 20 nt, Artificial Sequence
  spacer sequence
accuggacauggaguaugcu

SEQ ID NO: 7596 - RNA, 20 nt, Artificial Sequence
  spacer sequence
agguggagauuaggcagaag

SEQ ID NO: 7597 - RNA, 20 nt, Artificial Sequence
  spacer sequence
auguccagguggagauuagg

SEQ ID NO: 7598 - RNA, 20 nt, Artificial Sequence
  spacer sequence
gcauacuccauguccaggug

SEQ ID NO: 7599 - RNA, 20 nt, Artificial Sequence
  spacer sequence
cauuucaaauuucuguaauu

SEQ ID NO: 7600 - RNA, 20 nt, Artificial Sequence
  spacer sequence
uuucaaauuucuguaauuac

SEQ ID NO: 7601 - RNA, 20 nt, Artificial Sequence
  spacer sequence
aauuucuguaauuacaaccc

SEQ ID NO: 7602 - RNA, 20 nt, Artificial Sequence
  spacer sequence
guaauuacaacccaagugga

SEQ ID NO: 7603 - RNA, 20 nt, Artificial Sequence
  spacer sequence
acuuggguuguaauuacaga

SEQ ID NO: 7604 - RNA, 20 nt, Artificial Sequence
  spacer sequence
uucuggccaguaaucuaaca

SEQ ID NO: 7605 - RNA, 20 nt, Artificial Sequence
  spacer sequence
ggccaguaaucuaacauuuu

SEQ ID NO: 7606 - RNA, 20 nt, Artificial Sequence
  spacer sequence
aacauuuuccuagucaaucc

SEQ ID NO: 7607 - RNA, 20 nt, Artificial Sequence
  spacer sequence
uagucaauccacauucucau

SEQ ID NO: 7608 - RNA, 20 nt, Artificial Sequence
  spacer sequence
auccacauucucauguccug

SEQ ID NO: 7609 - RNA, 20 nt, Artificial Sequence
  spacer sequence
acauucucauguccuggaug

SEQ ID NO: 7610 - RNA, 20 nt, Artificial Sequence
  spacer sequence
cauguccuggaugaggacac

SEQ ID NO: 7611 - RNA, 20 nt, Artificial Sequence
  spacer sequence
uguccuggaugaggacacau

SEQ ID NO: 7612 - RNA, 20 nt, Artificial Sequence
  spacer sequence
uggaugaggacacauguuca

SEQ ID NO: 7613 - RNA, 20 nt, Artificial Sequence
  spacer sequence
aggacaugagaauguggauu

SEQ ID NO: 7614 - RNA, 20 nt, Artificial Sequence
  spacer sequence
uccaggacaugagaaugugg

SEQ ID NO: 7615 - RNA, 20 nt, Artificial Sequence
  spacer sequence
ucauccaggacaugagaaug

SEQ ID NO: 7616 - RNA, 20 nt, Artificial Sequence
  spacer sequence
agguccuccuucauccuguc

SEQ ID NO: 7617 - RNA, 20 nt, Artificial Sequence
  spacer sequence
uccuucauccugucuacucu

SEQ ID NO: 7618 - RNA, 20 nt, Artificial Sequence
  spacer sequence
uucauccugucuacucuuag

SEQ ID NO: 7619 - RNA, 20 nt, Artificial Sequence
  spacer sequence
uccugucuacucuuaguugu

SEQ ID NO: 7620 - RNA, 20 nt, Artificial Sequence
  spacer sequence
ugucuacucuuaguuguuuu

SEQ ID NO: 7621 - RNA, 20 nt, Artificial Sequence
  spacer sequence
acucuuaguuguuuuguuug

SEQ ID NO: 7622 - RNA, 20 nt, Artificial Sequence
  spacer sequence
uaguuguuuuguuugguaau

SEQ ID NO: 7623 - RNA, 20 nt, Artificial Sequence
  spacer sequence
guaagguaaaauucacacau

SEQ ID NO: 7624 - RNA, 20 nt, Artificial Sequence
  spacer sequence
cacauccuguaauuuaccca

SEQ ID NO: 7625 - RNA, 20 nt, Artificial Sequence
  spacer sequence
uguaauuuacccacauaaau

SEQ ID NO: 7626 - RNA, 20 nt, Artificial Sequence
  spacer sequence
augguuuuaguauauucaca

SEQ ID NO: 7627 - RNA, 20 nt, Artificial Sequence
  spacer sequence
cagaauugggcaacuaucac

SEQ ID NO: 7628 - RNA, 20 nt, Artificial Sequence
  spacer sequence
gugaauauacuaaaaccauu

SEQ ID NO: 7629 - RNA, 20 nt, Artificial Sequence
  spacer sequence
caaucaacuuuagaacauuu

SEQ ID NO: 7630 - RNA, 20 nt, Artificial Sequence
  spacer sequence
acuuuagaacauuuuuauua

SEQ ID NO: 7631 - RNA, 20 nt, Artificial Sequence
  spacer sequence
aaaguugauugugauaguug

SEQ ID NO: 7632 - RNA, 20 nt, Artificial Sequence
  spacer sequence
uuuuaggguaauaaaaaugu

SEQ ID NO: 7633 - RNA, 20 nt, Artificial Sequence
  spacer sequence
ugcauccgugggccaucucu

SEQ ID NO: 7634 - RNA, 20 nt, Artificial Sequence
  spacer sequence
gugggccaucucuauuuccc

SEQ ID NO: 7635 - RNA, 20 nt, Artificial Sequence
  spacer sequence
cuauuuccccagcuuucccc

SEQ ID NO: 7636 - RNA, 20 nt, Artificial Sequence
  spacer sequence
auuuccccagcuuuccccuc

SEQ ID NO: 7637 - RNA, 20 nt, Artificial Sequence
  spacer sequence
ccagcuuuccccucaucugu

SEQ ID NO: 7638 - RNA, 20 nt, Artificial Sequence
  spacer sequence
ccucaucugucccagcccca

SEQ ID NO: 7639 - RNA, 20 nt, Artificial Sequence
  spacer sequence
ucugucccagccccaagcaa

SEQ ID NO: 7640 - RNA, 20 nt, Artificial Sequence
  spacer sequence
gucccagccccaagcaacca

SEQ ID NO: 7641 - RNA, 20 nt, Artificial Sequence
  spacer sequence
cagccccaagcaaccacaua

SEQ ID NO: 7642 - RNA, 20 nt, Artificial Sequence
  spacer sequence
gucucuguggguuuaccuau

SEQ ID NO: 7643 - RNA, 20 nt, Artificial Sequence
  spacer sequence
cuguggguuuaccuauuaac

SEQ ID NO: 7644 - RNA, 20 nt, Artificial Sequence
  spacer sequence
guggguuuaccuauuaacau

SEQ ID NO: 7645 - RNA, 20 nt, Artificial Sequence
  spacer sequence
guauaaauggaaucauaaaa

SEQ ID NO: 7646 - RNA, 20 nt, Artificial Sequence
  spacer sequence
auuuauacagaauguuaaua

SEQ ID NO: 7647 - RNA, 20 nt, Artificial Sequence
  spacer sequence
uaaaauaugugguccugugu

SEQ ID NO: 7648 - RNA, 20 nt, Artificial Sequence
  spacer sequence
ugugugacugacuuuugcuu

SEQ ID NO: 7649 - RNA, 20 nt, Artificial Sequence
  spacer sequence
cacaggaccacauauuuuau

SEQ ID NO: 7650 - RNA, 20 nt, Artificial Sequence
  spacer sequence
gucacacaggaccacauauu

SEQ ID NO: 7651 - RNA, 20 nt, Artificial Sequence
  spacer sequence
ucucaagguucauccauguu

SEQ ID NO: 7652 - RNA, 20 nt, Artificial Sequence
  spacer sequence
caagguucauccauguugca

SEQ ID NO: 7653 - RNA, 20 nt, Artificial Sequence
  spacer sequence
agguucauccauguugcaug

SEQ ID NO: 7654 - RNA, 20 nt, Artificial Sequence
  spacer sequence
uccauguugcauguuuaagu

SEQ ID NO: 7655 - RNA, 20 nt, Artificial Sequence
  spacer sequence
auguugcauguuuaaguccu

SEQ ID NO: 7656 - RNA, 20 nt, Artificial Sequence
  spacer sequence
uucauuuuuuauuacuaaua

SEQ ID NO: 7657 - RNA, 20 nt, Artificial Sequence
  spacer sequence
uuuuuuauuacuaauauucc

SEQ ID NO: 7658 - RNA, 20 nt, Artificial Sequence
  spacer sequence
gugauaugaauauaccauau

SEQ ID NO: 7659 - RNA, 20 nt, Artificial Sequence
  spacer sequence
cggaauauuaguaauaaaaa

SEQ ID NO: 7660 - RNA, 20 nt, Artificial Sequence
  spacer sequence
uaucacggaauauuaguaau

SEQ ID NO: 7661 - RNA, 20 nt, Artificial Sequence
  spacer sequence
uuuuuuuaaaaaggucuuua

SEQ ID NO: 7662 - RNA, 20 nt, Artificial Sequence
  spacer sequence
uuagaaaaagacuuuuucau

SEQ ID NO: 7663 - RNA, 20 nt, Artificial Sequence
  spacer sequence
aaagaccuuuuuaaaaaaau

SEQ ID NO: 7664 - RNA, 20 nt, Artificial Sequence
  spacer sequence
uuuucuaaagaccuuuuuaa

SEQ ID NO: 7665 - RNA, 20 nt, Artificial Sequence
  spacer sequence
uccacccacaugccaccaaa

SEQ ID NO: 7666 - RNA, 20 nt, Artificial Sequence
  spacer sequence
acccacaugccaccaaaucu

SEQ ID NO: 7667 - RNA, 20 nt, Artificial Sequence
  spacer sequence
accaauuuaccugcaccuga

SEQ ID NO: 7668 - RNA, 20 nt, Artificial Sequence
  spacer sequence
ggugcagguaaauugguaga

SEQ ID NO: 7669 - RNA, 20 nt, Artificial Sequence
  spacer sequence
acauuacuccuacugucugu

SEQ ID NO: 7670 - RNA, 20 nt, Artificial Sequence
  spacer sequence
uacugucugugacuguccgu

SEQ ID NO: 7671 - RNA, 20 nt, Artificial Sequence
  spacer sequence
gugacuguccgugcuccaau

SEQ ID NO: 7672 - RNA, 20 nt, Artificial Sequence
  spacer sequence
cagacaguaggaguaaugug

SEQ ID NO: 7673 - RNA, 20 nt, Artificial Sequence
  spacer sequence
gugcuccaaugguuacaccu

SEQ ID NO: 7674 - RNA, 20 nt, Artificial Sequence
  spacer sequence
aaugguuacaccuguuauuu

SEQ ID NO: 7675 - RNA, 20 nt, Artificial Sequence
  spacer sequence
aggguacaaauaacaggugu

SEQ ID NO: 7676 - RNA, 20 nt, Artificial Sequence
  spacer sequence
guccccucucaccuacauaa

SEQ ID NO: 7677 - RNA, 20 nt, Artificial Sequence
  spacer sequence
ccucucaccuacauaacaac

SEQ ID NO: 7678 - RNA, 20 nt, Artificial Sequence
  spacer sequence
caccuacauaacaaccgagc

SEQ ID NO: 7679 - RNA, 20 nt, Artificial Sequence
  spacer sequence
ccuacauaacaaccgagcac

SEQ ID NO: 7680 - RNA, 20 nt, Artificial Sequence
  spacer sequence
guuguuauguaggugagagg

SEQ ID NO: 7681 - RNA, 20 nt, Artificial Sequence
  spacer sequence
ugcuugcaccaacauucucc

SEQ ID NO: 7682 - RNA, 20 nt, Artificial Sequence
  spacer sequence
ccccucuacugggcuuccca

SEQ ID NO: 7683 - RNA, 20 nt, Artificial Sequence
  spacer sequence
ccucuacugggcuucccaau

SEQ ID NO: 7684 - RNA, 20 nt, Artificial Sequence
  spacer sequence
acugggcuucccaaucauaa

SEQ ID NO: 7685 - RNA, 20 nt, Artificial Sequence
  spacer sequence
caaucauaaguaugcuguag

SEQ ID NO: 7686 - RNA, 20 nt, Artificial Sequence
  spacer sequence
uaaguaugcuguaguuuuug

SEQ ID NO: 7687 - RNA, 20 nt, Artificial Sequence
  spacer sequence
uucagaaacaagaacaaaaa

SEQ ID NO: 7688 - RNA, 20 nt, Artificial Sequence
  spacer sequence
gaaacaagaacaaaaauuaa

SEQ ID NO: 7689 - RNA, 20 nt, Artificial Sequence
  spacer sequence
gaaagaugggcaaaaacuac

SEQ ID NO: 7690 - RNA, 20 nt, Artificial Sequence
  spacer sequence
uguuucugaaagaugggcaa

SEQ ID NO: 7691 - RNA, 20 nt, Artificial Sequence
  spacer sequence
cucacccugcaucuccuuuc

SEQ ID NO: 7692 - RNA, 20 nt, Artificial Sequence
  spacer sequence
cccugcaucuccuuucaggu

SEQ ID NO: 7693 - RNA, 20 nt, Artificial Sequence
  spacer sequence
ccuuucagguaucaccccau

SEQ ID NO: 7694 - RNA, 20 nt, Artificial Sequence
  spacer sequence
uuucagguaucaccccaucu

SEQ ID NO: 7695 - RNA, 20 nt, Artificial Sequence
  spacer sequence
gguaucaccccaucuuguuu

SEQ ID NO: 7696 - RNA, 20 nt, Artificial Sequence
  spacer sequence
ccccaucuuguuuuucuccu

SEQ ID NO: 7697 - RNA, 20 nt, Artificial Sequence
  spacer sequence
uguuuuucuccucuauagca

SEQ ID NO: 7698 - RNA, 20 nt, Artificial Sequence
  spacer sequence
ccucuauagcaaaucuccug

SEQ ID NO: 7699 - RNA, 20 nt, Artificial Sequence
  spacer sequence
ucuauagcaaaucuccugag

SEQ ID NO: 7700 - RNA, 20 nt, Artificial Sequence
  spacer sequence
auagcaaaucuccugagaug

SEQ ID NO: 7701 - RNA, 20 nt, Artificial Sequence
  spacer sequence
ccugagauguucaaaauccu

SEQ ID NO: 7702 - RNA, 20 nt, Artificial Sequence
  spacer sequence
ugagauguucaaaauccuaa

SEQ ID NO: 7703 - RNA, 20 nt, Artificial Sequence
  spacer sequence
ggagauuugcuauagaggag

SEQ ID NO: 7704 - RNA, 20 nt, Artificial Sequence
  spacer sequence
caggagauuugcuauagagg

SEQ ID NO: 7705 - RNA, 20 nt, Artificial Sequence
  spacer sequence
aaauccuaauuguauccuuc

SEQ ID NO: 7706 - RNA, 20 nt, Artificial Sequence
  spacer sequence
uaauuguauccuucaucucc

SEQ ID NO: 7707 - RNA, 20 nt, Artificial Sequence
  spacer sequence
uucaucucccagucucucac

SEQ ID NO: 7708 - RNA, 20 nt, Artificial Sequence
  spacer sequence
ucucccagucucucacaacc

SEQ ID NO: 7709 - RNA, 20 nt, Artificial Sequence
  spacer sequence
cccagucucucacaacccua

SEQ ID NO: 7710 - RNA, 20 nt, Artificial Sequence
  spacer sequence
cagucucucacaacccuaug

SEQ ID NO: 7711 - RNA, 20 nt, Artificial Sequence
  spacer sequence
cucacaacccuauguaacug

SEQ ID NO: 7712 - RNA, 20 nt, Artificial Sequence
  spacer sequence
cacaacccuauguaacuggg

SEQ ID NO: 7713 - RNA, 20 nt, Artificial Sequence
  spacer sequence
caacccuauguaacugggcu

SEQ ID NO: 7714 - RNA, 20 nt, Artificial Sequence
  spacer sequence
aaagcccaguuacauagggu

SEQ ID NO: 7715 - RNA, 20 nt, Artificial Sequence
  spacer sequence
ucaauccaaugaaagcacuu

SEQ ID NO: 7716 - RNA, 20 nt, Artificial Sequence
  spacer sequence
auccaaugaaagcacuuuuc

SEQ ID NO: 7717 - RNA, 20 nt, Artificial Sequence
  spacer sequence
aaugaaagcacuuuucucac

SEQ ID NO: 7718 - RNA, 20 nt, Artificial Sequence
  spacer sequence
uuggauugaugaguucaaaa

SEQ ID NO: 7719 - RNA, 20 nt, Artificial Sequence
  spacer sequence
cacagucaccaggagccuuc

SEQ ID NO: 7720 - RNA, 20 nt, Artificial Sequence
  spacer sequence
cagucaccaggagccuucau

SEQ ID NO: 7721 - RNA, 20 nt, Artificial Sequence
  spacer sequence
ccaggagccuucauuuugcu

SEQ ID NO: 7722 - RNA, 20 nt, Artificial Sequence
  spacer sequence
uggugacugugagaaaagug

SEQ ID NO: 7723 - RNA, 20 nt, Artificial Sequence
  spacer sequence
uuuugcuaaauccagcugcc

SEQ ID NO: 7724 - RNA, 20 nt, Artificial Sequence
  spacer sequence
agcugccaagucgcagcgcu

SEQ ID NO: 7725 - RNA, 20 nt, Artificial Sequence
  spacer sequence
cagcgcucuuucuugaucca

SEQ ID NO: 7726 - RNA, 20 nt, Artificial Sequence
  spacer sequence
uucuugauccaucaguguca

SEQ ID NO: 7727 - RNA, 20 nt, Artificial Sequence
  spacer sequence
ugauccaucagugucaucug

SEQ ID NO: 7728 - RNA, 20 nt, Artificial Sequence
  spacer sequence
agaaagagcgcugcgacuug

SEQ ID NO: 7729 - RNA, 20 nt, Artificial Sequence
  spacer sequence
aucagugucaucugauaguu

SEQ ID NO: 7730 - RNA, 20 nt, Artificial Sequence
  spacer sequence
gugucaucugauaguucacc

SEQ ID NO: 7731 - RNA, 20 nt, Artificial Sequence
  spacer sequence
ucugauaguucaccucucuc

SEQ ID NO: 7732 - RNA, 20 nt, Artificial Sequence
  spacer sequence
gauaguucaccucucucccc

SEQ ID NO: 7733 - RNA, 20 nt, Artificial Sequence
  spacer sequence
gaugacacugauggaucaag

SEQ ID NO: 7734 - RNA, 20 nt, Artificial Sequence
  spacer sequence
ccucucucccccucuuuccu

SEQ ID NO: 7735 - RNA, 20 nt, Artificial Sequence
  spacer sequence
cucccccucuuuccugccua

SEQ ID NO: 7736 - RNA, 20 nt, Artificial Sequence
  spacer sequence
cccccucuuuccugccuaga

SEQ ID NO: 7737 - RNA, 20 nt, Artificial Sequence
  spacer sequence
cccucuuuccugccuagaaa

SEQ ID NO: 7738 - RNA, 20 nt, Artificial Sequence
  spacer sequence
uuccugccuagaaacucuac

SEQ ID NO: 7739 - RNA, 20 nt, Artificial Sequence
  spacer sequence
ugccuagaaacucuacuugg

SEQ ID NO: 7740 - RNA, 20 nt, Artificial Sequence
  spacer sequence
aggcaggaaagagggggaga

SEQ ID NO: 7741 - RNA, 20 nt, Artificial Sequence
  spacer sequence
acuuggcuuucagauuaucu

SEQ ID NO: 7742 - RNA, 20 nt, Artificial Sequence
  spacer sequence
gauuaucucccucuacauuu

SEQ ID NO: 7743 - RNA, 20 nt, Artificial Sequence
  spacer sequence
gaaagccaaguagaguuucu

SEQ ID NO: 7744 - RNA, 20 nt, Artificial Sequence
  spacer sequence
cccucuacauuuuuauccua

SEQ ID NO: 7745 - RNA, 20 nt, Artificial Sequence
  spacer sequence
cucuacauuuuuauccuagc

SEQ ID NO: 7746 - RNA, 20 nt, Artificial Sequence
  spacer sequence
acauuuuuauccuagcccac

SEQ ID NO: 7747 - RNA, 20 nt, Artificial Sequence
  spacer sequence
uagcccacgggcuguaccuu

SEQ ID NO: 7748 - RNA, 20 nt, Artificial Sequence
  spacer sequence
cagcauccuuugcuggagag

SEQ ID NO: 7749 - RNA, 20 nt, Artificial Sequence
  spacer sequence
gcauccuuugcuggagagua

SEQ ID NO: 7750 - RNA, 20 nt, Artificial Sequence
  spacer sequence
uuugcuggagaguacaguau

SEQ ID NO: 7751 - RNA, 20 nt, Artificial Sequence
  spacer sequence
agcaaaggaugcugagaagg

SEQ ID NO: 7752 - RNA, 20 nt, Artificial Sequence
  spacer sequence
ccagcaaaggaugcugagaa

SEQ ID NO: 7753 - RNA, 20 nt, Artificial Sequence
  spacer sequence
auacuguacucuccagcaaa

SEQ ID NO: 7754 - RNA, 20 nt, Artificial Sequence
  spacer sequence
aaagcacaggcuccuguugg

SEQ ID NO: 7755 - RNA, 20 nt, Artificial Sequence
  spacer sequence
uguuggaguggggcuaccuu

SEQ ID NO: 7756 - RNA, 20 nt, Artificial Sequence
  spacer sequence
aacaggagccugugcuuuug

SEQ ID NO: 7757 - RNA, 20 nt, Artificial Sequence
  spacer sequence
agguagccccacuccaacag

SEQ ID NO: 7758 - RNA, 20 nt, Artificial Sequence
  spacer sequence
aacacggcuacuuguagcua

SEQ ID NO: 7759 - RNA, 20 nt, Artificial Sequence
  spacer sequence
cauagcuacaaguagccgug

SEQ ID NO: 7760 - RNA, 20 nt, Artificial Sequence
  spacer sequence
aagggucacauagcuacaag

SEQ ID NO: 7761 - RNA, 20 nt, Artificial Sequence
  spacer sequence
ucuccaagugcuucagucuc

SEQ ID NO: 7762 - RNA, 20 nt, Artificial Sequence
  spacer sequence
ccaagugcuucagucucccc

SEQ ID NO: 7763 - RNA, 20 nt, Artificial Sequence
  spacer sequence
aagugcuucagucuccccau

SEQ ID NO: 7764 - RNA, 20 nt, Artificial Sequence
  spacer sequence
gucuccccaucuauaaaaug

SEQ ID NO: 7765 - RNA, 20 nt, Artificial Sequence
  spacer sequence
ccccaucuauaaaaugaaga

SEQ ID NO: 7766 - RNA, 20 nt, Artificial Sequence
  spacer sequence
ccaucuauaaaaugaagaua

SEQ ID NO: 7767 - RNA, 20 nt, Artificial Sequence
  spacer sequence
auaaaaugaagauaacccug

SEQ ID NO: 7768 - RNA, 20 nt, Artificial Sequence
  spacer sequence
uuuuauagauggggagacug

SEQ ID NO: 7769 - RNA, 20 nt, Artificial Sequence
  spacer sequence
ucauuuuauagauggggaga

SEQ ID NO: 7770 - RNA, 20 nt, Artificial Sequence
  spacer sequence
ggguuaucuucauuuuauag

SEQ ID NO: 7771 - RNA, 20 nt, Artificial Sequence
  spacer sequence
uuuaacccuugcagcccuca

SEQ ID NO: 7772 - RNA, 20 nt, Artificial Sequence
  spacer sequence
uaagcaguuuguguauauua

SEQ ID NO: 7773 - RNA, 20 nt, Artificial Sequence
  spacer sequence
ggcacguggaacuaugucua

SEQ ID NO: 7774 - RNA, 20 nt, Artificial Sequence
  spacer sequence
acgugccagaaacucuuaag

SEQ ID NO: 7775 - RNA, 20 nt, Artificial Sequence
  spacer sequence
accuuagucucacagcauca

SEQ ID NO: 7776 - RNA, 20 nt, Artificial Sequence
  spacer sequence
cacagcaucauauucuuagc

SEQ ID NO: 7777 - RNA, 20 nt, Artificial Sequence
  spacer sequence
cagcaucauauucuuagcug

SEQ ID NO: 7778 - RNA, 20 nt, Artificial Sequence
  spacer sequence
uauucuuagcugccaaaugc

SEQ ID NO: 7779 - RNA, 20 nt, Artificial Sequence
  spacer sequence
uagcugccaaaugcugaaga

SEQ ID NO: 7780 - RNA, 20 nt, Artificial Sequence
  spacer sequence
gcauuuggcagcuaagaaua

SEQ ID NO: 7781 - RNA, 20 nt, Artificial Sequence
  spacer sequence
ucagcauuuggcagcuaaga

SEQ ID NO: 7782 - RNA, 20 nt, Artificial Sequence
  spacer sequence
ucagaccucucaccacuucu

SEQ ID NO: 7783 - RNA, 20 nt, Artificial Sequence
  spacer sequence
gaccucucaccacuucucua

SEQ ID NO: 7784 - RNA, 20 nt, Artificial Sequence
  spacer sequence
gaggacaaaauucuucagca

SEQ ID NO: 7785 - RNA, 20 nt, Artificial Sequence
  spacer sequence
caccacuucucuauuuacau

SEQ ID NO: 7786 - RNA, 20 nt, Artificial Sequence
  spacer sequence
ccacuucucuauuuacauuu

SEQ ID NO: 7787 - RNA, 20 nt, Artificial Sequence
  spacer sequence
cuauuuacauuuucuccuua

SEQ ID NO: 7788 - RNA, 20 nt, Artificial Sequence
  spacer sequence
auuuacauuuucuccuuagg

SEQ ID NO: 7789 - RNA, 20 nt, Artificial Sequence
  spacer sequence
ccuuagguaaucucacaggc

SEQ ID NO: 7790 - RNA, 20 nt, Artificial Sequence
  spacer sequence
uuagguaaucucacaggcuc

SEQ ID NO: 7791 - RNA, 20 nt, Artificial Sequence
  spacer sequence
cacaggcuccugcggcuuua

SEQ ID NO: 7792 - RNA, 20 nt, Artificial Sequence
  spacer sequence
caggcuccugcggcuuuaaa

SEQ ID NO: 7793 - RNA, 20 nt, Artificial Sequence
  spacer sequence
ugcggcuuuaaauauuaucu

SEQ ID NO: 7794 - RNA, 20 nt, Artificial Sequence
  spacer sequence
uuaucugcugaagaugccag

SEQ ID NO: 7795 - RNA, 20 nt, Artificial Sequence
  spacer sequence
gcugaagaugccagaauuug

SEQ ID NO: 7796 - RNA, 20 nt, Artificial Sequence
  spacer sequence
gcagauaaagauaauauuua

SEQ ID NO: 7797 - RNA, 20 nt, Artificial Sequence
  spacer sequence
ucagcagauaaagauaauau

SEQ ID NO: 7798 - RNA, 20 nt, Artificial Sequence
  spacer sequence
ggcaucuucagcagauaaag

SEQ ID NO: 7799 - RNA, 20 nt, Artificial Sequence
  spacer sequence
auuagauguuaccaguaguu

SEQ ID NO: 7800 - RNA, 20 nt, Artificial Sequence
  spacer sequence
aauagagcugcaaauucugg

SEQ ID NO: 7801 - RNA, 20 nt, Artificial Sequence
  spacer sequence
aguaaacuacugguaacauc

SEQ ID NO: 7802 - RNA, 20 nt, Artificial Sequence
  spacer sequence
guaccuggguaucaaaguua

SEQ ID NO: 7803 - RNA, 20 nt, Artificial Sequence
  spacer sequence
aaguuagaauauccaacauu

SEQ ID NO: 7804 - RNA, 20 nt, Artificial Sequence
  spacer sequence
aacuuugauacccagguaca

SEQ ID NO: 7805 - RNA, 20 nt, Artificial Sequence
  spacer sequence
aacauuuuaauuugauaggc

SEQ ID NO: 7806 - RNA, 20 nt, Artificial Sequence
  spacer sequence
aauuaaaauguuggauauuc

SEQ ID NO: 7807 - RNA, 20 nt, Artificial Sequence
  spacer sequence
ccucaaacccacuccuacag

SEQ ID NO: 7808 - RNA, 20 nt, Artificial Sequence
  spacer sequence
aacccacuccuacagauuug

SEQ ID NO: 7809 - RNA, 20 nt, Artificial Sequence
  spacer sequence
uacagauuugcgcaucacag

SEQ ID NO: 7810 - RNA, 20 nt, Artificial Sequence
  spacer sequence
guaggaguggguuugagggg

SEQ ID NO: 7811 - RNA, 20 nt, Artificial Sequence
  spacer sequence
caggaauggcaauuacaucu

SEQ ID NO: 7812 - RNA, 20 nt, Artificial Sequence
  spacer sequence
ugugaugcgcaaaucuguag

SEQ ID NO: 7813 - RNA, 20 nt, Artificial Sequence
  spacer sequence
accaguugcucacauaaaaa

SEQ ID NO: 7814 - RNA, 20 nt, Artificial Sequence
  spacer sequence
cauaaaaaacgagucauucu

SEQ ID NO: 7815 - RNA, 20 nt, Artificial Sequence
  spacer sequence
uuuuuuaugugagcaacugg

SEQ ID NO: 7816 - RNA, 20 nt, Artificial Sequence
  spacer sequence
uucuugacucuuuuucgcau

SEQ ID NO: 7817 - RNA, 20 nt, Artificial Sequence
  spacer sequence
ugacucuuuuucgcauuccg

SEQ ID NO: 7818 - RNA, 20 nt, Artificial Sequence
  spacer sequence
agaaugacucguuuuuuaug

SEQ ID NO: 7819 - RNA, 20 nt, Artificial Sequence
  spacer sequence
uuuucgcauuccguauuuaa

SEQ ID NO: 7820 - RNA, 20 nt, Artificial Sequence
  spacer sequence
cauuccguauuuaaguaaua

SEQ ID NO: 7821 - RNA, 20 nt, Artificial Sequence
  spacer sequence
guauuuaaguaauauggcaa

SEQ ID NO: 7822 - RNA, 20 nt, Artificial Sequence
  spacer sequence
gaaggcucuaucuucaaaau

SEQ ID NO: 7823 - RNA, 20 nt, Artificial Sequence
  spacer sequence
gaauugccauauuacuuaaa

SEQ ID NO: 7824 - RNA, 20 nt, Artificial Sequence
  spacer sequence
aucuucaaaauaucuucaga

SEQ ID NO: 7825 - RNA, 20 nt, Artificial Sequence
  spacer sequence
ucaaaauaucuucagacucu

SEQ ID NO: 7826 - RNA, 20 nt, Artificial Sequence
  spacer sequence
aaauaucuucagacucuaac

SEQ ID NO: 7827 - RNA, 20 nt, Artificial Sequence
  spacer sequence
ucagacucuaaccacuuauc

SEQ ID NO: 7828 - RNA, 20 nt, Artificial Sequence
  spacer sequence
gacucuaaccacuuaucacc

SEQ ID NO: 7829 - RNA, 20 nt, Artificial Sequence
  spacer sequence
gaagauauuuugaagauaga

SEQ ID NO: 7830 - RNA, 20 nt, Artificial Sequence
  spacer sequence
aaccacuuaucaccuccauu

SEQ ID NO: 7831 - RNA, 20 nt, Artificial Sequence
  spacer sequence
ccuccauugcaccagcccaa

SEQ ID NO: 7832 - RNA, 20 nt, Artificial Sequence
  spacer sequence
auugcaccagcccaacgugg

SEQ ID NO: 7833 - RNA, 20 nt, Artificial Sequence
  spacer sequence
caucucaucugcugcaacag

SEQ ID NO: 7834 - RNA, 20 nt, Artificial Sequence
  spacer sequence
caucugcugcaacagcauca

SEQ ID NO: 7835 - RNA, 20 nt, Artificial Sequence
  spacer sequence
ucugcugcaacagcaucaga

SEQ ID NO: 7836 - RNA, 20 nt, Artificial Sequence
  spacer sequence
gcugcaacagcaucagaacc

SEQ ID NO: 7837 - RNA, 20 nt, Artificial Sequence
  spacer sequence
gaaccggucuccuuuccacu

SEQ ID NO: 7838 - RNA, 20 nt, Artificial Sequence
  spacer sequence
gaugcuguugcagcagauga

SEQ ID NO: 7839 - RNA, 20 nt, Artificial Sequence
  spacer sequence
ccuuuccacucuuaccaacu

SEQ ID NO: 7840 - RNA, 20 nt, Artificial Sequence
  spacer sequence
uuuccacucuuaccaacuuc

SEQ ID NO: 7841 - RNA, 20 nt, Artificial Sequence
  spacer sequence
acucuuaccaacuucuagag

SEQ ID NO: 7842 - RNA, 20 nt, Artificial Sequence
  spacer sequence
uaccaacuucuagagucugu

SEQ ID NO: 7843 - RNA, 20 nt, Artificial Sequence
  spacer sequence
agagucuguuucucuaacag

SEQ ID NO: 7844 - RNA, 20 nt, Artificial Sequence
  spacer sequence
agaaguugguaagaguggaa

SEQ ID NO: 7845 - RNA, 20 nt, Artificial Sequence
  spacer sequence
guuucucuaacagccacagu

SEQ ID NO: 7846 - RNA, 20 nt, Artificial Sequence
  spacer sequence
cuaacagccacaguaauacu

SEQ ID NO: 7847 - RNA, 20 nt, Artificial Sequence
  spacer sequence
aacagccacaguaauacuuu

SEQ ID NO: 7848 - RNA, 20 nt, Artificial Sequence
  spacer sequence
gaucauggcauggauaaaag

SEQ ID NO: 7849 - RNA, 20 nt, Artificial Sequence
  spacer sequence
gaugugcaguuuuuaaagua

SEQ ID NO: 7850 - RNA, 20 nt, Artificial Sequence
  spacer sequence
uggcauggauaaaagacucu

SEQ ID NO: 7851 - RNA, 20 nt, Artificial Sequence
  spacer sequence
augccaugaucugaugugca

SEQ ID NO: 7852 - RNA, 20 nt, Artificial Sequence
  spacer sequence
uuuauccaugccaugaucug

SEQ ID NO: 7853 - RNA, 20 nt, Artificial Sequence
  spacer sequence
acaccauuucccacugcacu

SEQ ID NO: 7854 - RNA, 20 nt, Artificial Sequence
  spacer sequence
cacugcacucaaagccuagu

SEQ ID NO: 7855 - RNA, 20 nt, Artificial Sequence
  spacer sequence
aagccuagugcucaacaacc

SEQ ID NO: 7856 - RNA, 20 nt, Artificial Sequence
  spacer sequence
acaaccuucucuaagcucau

SEQ ID NO: 7857 - RNA, 20 nt, Artificial Sequence
  spacer sequence
cuaagcucaucuccugccac

SEQ ID NO: 7858 - RNA, 20 nt, Artificial Sequence
  spacer sequence
aagcucaucuccugccacuu

SEQ ID NO: 7859 - RNA, 20 nt, Artificial Sequence
  spacer sequence
ucuccugccacuuucuuccc

SEQ ID NO: 7860 - RNA, 20 nt, Artificial Sequence
  spacer sequence
ccugccacuuucuucccuuu

SEQ ID NO: 7861 - RNA, 20 nt, Artificial Sequence
  spacer sequence
ugccacuuucuucccuuugc

SEQ ID NO: 7862 - RNA, 20 nt, Artificial Sequence
  spacer sequence
ucccuuugcucucccuuccu

SEQ ID NO: 7863 - RNA, 20 nt, Artificial Sequence
  spacer sequence
cuuugcucucccuuccugcu

SEQ ID NO: 7864 - RNA, 20 nt, Artificial Sequence
  spacer sequence
cccuuccugcugugguccuu

SEQ ID NO: 7865 - RNA, 20 nt, Artificial Sequence
  spacer sequence
cuuccugcugugguccuuca

SEQ ID NO: 7866 - RNA, 20 nt, Artificial Sequence
  spacer sequence
ugcugugguccuucaacaau

SEQ ID NO: 7867 - RNA, 20 nt, Artificial Sequence
  spacer sequence
uucaacaauccaugccccau

SEQ ID NO: 7868 - RNA, 20 nt, Artificial Sequence
  spacer sequence
acaauccaugccccaucuca

SEQ ID NO: 7869 - RNA, 20 nt, Artificial Sequence
  spacer sequence
augccccaucucaauucagg

SEQ ID NO: 7870 - RNA, 20 nt, Artificial Sequence
  spacer sequence
caauucaggcccccuuuccu

SEQ ID NO: 7871 - RNA, 20 nt, Artificial Sequence
  spacer sequence
auucaggcccccuuuccuuu

SEQ ID NO: 7872 - RNA, 20 nt, Artificial Sequence
  spacer sequence
ggcccccuuuccuuuggucc

SEQ ID NO: 7873 - RNA, 20 nt, Artificial Sequence
  spacer sequence
uuugguccucacucuacauu

SEQ ID NO: 7874 - RNA, 20 nt, Artificial Sequence
  spacer sequence
ucacucuacauuccuuuccu

SEQ ID NO: 7875 - RNA, 20 nt, Artificial Sequence
  spacer sequence
cucuacauuccuuuccucug

SEQ ID NO: 7876 - RNA, 20 nt, Artificial Sequence
  spacer sequence
acauuccuuuccucuguauu

SEQ ID NO: 7877 - RNA, 20 nt, Artificial Sequence
  spacer sequence
uuuccucuguauuuacaugg

SEQ ID NO: 7878 - RNA, 20 nt, Artificial Sequence
  spacer sequence
ucuguauuuacauggggaua

SEQ ID NO: 7879 - RNA, 20 nt, Artificial Sequence
  spacer sequence
guauuuacauggggauauuc

SEQ ID NO: 7880 - RNA, 20 nt, Artificial Sequence
  spacer sequence
ccauguaaauacagaggaaa

SEQ ID NO: 7881 - RNA, 20 nt, Artificial Sequence
  spacer sequence
cuucauuacugguucagaug

SEQ ID NO: 7882 - RNA, 20 nt, Artificial Sequence
  spacer sequence
ucauuacugguucagaugcc

SEQ ID NO: 7883 - RNA, 20 nt, Artificial Sequence
  spacer sequence
uuacugguucagaugccuuc

SEQ ID NO: 7884 - RNA, 20 nt, Artificial Sequence
  spacer sequence
gaugccuucccuagcaaucg

SEQ ID NO: 7885 - RNA, 20 nt, Artificial Sequence
  spacer sequence
gaaccaguaaugaagagaau

SEQ ID NO: 7886 - RNA, 20 nt, Artificial Sequence
  spacer sequence
cuagcaaucguauuuaaaau

SEQ ID NO: 7887 - RNA, 20 nt, Artificial Sequence
  spacer sequence
uauuuaaaauuguacauauc

SEQ ID NO: 7888 - RNA, 20 nt, Artificial Sequence
  spacer sequence
guguuacacccuuauacugc

SEQ ID NO: 7889 - RNA, 20 nt, Artificial Sequence
  spacer sequence
uguuuuacucuccauguuaa

SEQ ID NO: 7890 - RNA, 20 nt, Artificial Sequence
  spacer sequence
ccauguuaaauuauuagccc

SEQ ID NO: 7891 - RNA, 20 nt, Artificial Sequence
  spacer sequence
auguuaaauuauuagcccag

SEQ ID NO: 7892 - RNA, 20 nt, Artificial Sequence
  spacer sequence
gcgaaaauauaaacuccaga

SEQ ID NO: 7893 - RNA, 20 nt, Artificial Sequence
  spacer sequence
cagaccugggcuaauaauuu

SEQ ID NO: 7894 - RNA, 20 nt, Artificial Sequence
  spacer sequence
agaaagacagguuuuguuuu

SEQ ID NO: 7895 - RNA, 20 nt, Artificial Sequence
  spacer sequence
ggaguuuauauuuucgcaga

SEQ ID NO: 7896 - RNA, 20 nt, Artificial Sequence
  spacer sequence
uucuggaguuuauauuuucg

SEQ ID NO: 7897 - RNA, 20 nt, Artificial Sequence
  spacer sequence
uucugguauuucuaguauac

SEQ ID NO: 7898 - RNA, 20 nt, Artificial Sequence
  spacer sequence
gguauuucuaguauaccuag

SEQ ID NO: 7899 - RNA, 20 nt, Artificial Sequence
  spacer sequence
aguauaccuagaagggugcc

SEQ ID NO: 7900 - RNA, 20 nt, Artificial Sequence
  spacer sequence
agguauacuagaaauaccag

SEQ ID NO: 7901 - RNA, 20 nt, Artificial Sequence
  spacer sequence
auaaccauugugugccaggc

SEQ ID NO: 7902 - RNA, 20 nt, Artificial Sequence
  spacer sequence
aaucaauaaccauugugugc

SEQ ID NO: 7903 - RNA, 20 nt, Artificial Sequence
  spacer sequence
auaaauaucuaaucaauaac

SEQ ID NO: 7904 - RNA, 20 nt, Artificial Sequence
  spacer sequence
uauguucaauaaauaucuaa

SEQ ID NO: 7905 - RNA, 20 nt, Artificial Sequence
  spacer sequence
cucauauguucaauaaauau

SEQ ID NO: 7906 - RNA, 20 nt, Artificial Sequence
  spacer sequence
gcaaacaccauucacucaua

SEQ ID NO: 7907 - RNA, 20 nt, Artificial Sequence
  spacer sequence
ccucugcaaacaccauucac

SEQ ID NO: 7908 - RNA, 20 nt, Artificial Sequence
  spacer sequence
ucaccucugcaaacaccauu

SEQ ID NO: 7909 - RNA, 20 nt, Artificial Sequence
  spacer sequence
ucaaggagaagauaccucuc

SEQ ID NO: 7910 - RNA, 20 nt, Artificial Sequence
  spacer sequence
aggagaagauaccucucagg

SEQ ID NO: 7911 - RNA, 20 nt, Artificial Sequence
  spacer sequence
uugaugaguuuggucaucac

SEQ ID NO: 7912 - RNA, 20 nt, Artificial Sequence
  spacer sequence
ccuugaugaguuuggucauc

SEQ ID NO: 7913 - RNA, 20 nt, Artificial Sequence
  spacer sequence
ucuccuugaugaguuugguc

SEQ ID NO: 7914 - RNA, 20 nt, Artificial Sequence
  spacer sequence
cagggaauuaagaauagagg

SEQ ID NO: 7915 - RNA, 20 nt, Artificial Sequence
  spacer sequence
gggaauuaagaauagaggcu

SEQ ID NO: 7916 - RNA, 20 nt, Artificial Sequence
  spacer sequence
cugagagguaucuucuccuu

SEQ ID NO: 7917 - RNA, 20 nt, Artificial Sequence
  spacer sequence
uaauucccugagagguaucu

SEQ ID NO: 7918 - RNA, 20 nt, Artificial Sequence
  spacer sequence
auucuuaauucccugagagg

SEQ ID NO: 7919 - RNA, 20 nt, Artificial Sequence
  spacer sequence
aggucuuuucccaggguggu

SEQ ID NO: 7920 - RNA, 20 nt, Artificial Sequence
  spacer sequence
uuucccagggugguaagaau

SEQ ID NO: 7921 - RNA, 20 nt, Artificial Sequence
  spacer sequence
cagggugguaagaaucuucc

SEQ ID NO: 7922 - RNA, 20 nt, Artificial Sequence
  spacer sequence
uaccacccugggaaaagacc

SEQ ID NO: 7923 - RNA, 20 nt, Artificial Sequence
  spacer sequence
ucccagcauaaaccuaggag

SEQ ID NO: 7924 - RNA, 20 nt, Artificial Sequence
  spacer sequence
cagcauaaaccuaggaggac

SEQ ID NO: 7925 - RNA, 20 nt, Artificial Sequence
  spacer sequence
uagguuuaugcugggaagau

SEQ ID NO: 7926 - RNA, 20 nt, Artificial Sequence
  spacer sequence
uccuagguuuaugcugggaa

SEQ ID NO: 7927 - RNA, 20 nt, Artificial Sequence
  spacer sequence
aguccuccuagguuuaugcu

SEQ ID NO: 7928 - RNA, 20 nt, Artificial Sequence
  spacer sequence
aaguucaaguccuccuaggu

SEQ ID NO: 7929 - RNA, 20 nt, Artificial Sequence
  spacer sequence
caaaguucaaguccuccuag

SEQ ID NO: 7930 - RNA, 20 nt, Artificial Sequence
  spacer sequence
uuucucaaaguucaaguccu

SEQ ID NO: 7931 - RNA, 20 nt, Artificial Sequence
  spacer sequence
uucaaccuccuuuucuguuc

SEQ ID NO: 7932 - RNA, 20 nt, Artificial Sequence
  spacer sequence
accuccuuuucuguucuuug

SEQ ID NO: 7933 - RNA, 20 nt, Artificial Sequence
  spacer sequence
uuuucuguucuuuguugcag

SEQ ID NO: 7934 - RNA, 20 nt, Artificial Sequence
  spacer sequence
guucuuuguugcaguuccac

SEQ ID NO: 7935 - RNA, 20 nt, Artificial Sequence
  spacer sequence
uuguugcaguuccaccguuu

SEQ ID NO: 7936 - RNA, 20 nt, Artificial Sequence
  spacer sequence
accguuuugauuugaucucu

SEQ ID NO: 7937 - RNA, 20 nt, Artificial Sequence
  spacer sequence
aaacgguggaacugcaacaa

SEQ ID NO: 7938 - RNA, 20 nt, Artificial Sequence
  spacer sequence
aaucaaaacgguggaacugc

SEQ ID NO: 7939 - RNA, 20 nt, Artificial Sequence
  spacer sequence
cuacagaaugagugucacug

SEQ ID NO: 7940 - RNA, 20 nt, Artificial Sequence
  spacer sequence
acagaaugagugucacugug

SEQ ID NO: 7941 - RNA, 20 nt, Artificial Sequence
  spacer sequence
guagagaucaaaucaaaacg

SEQ ID NO: 7942 - RNA, 20 nt, Artificial Sequence
  spacer sequence
uucuguagagaucaaaucaa

SEQ ID NO: 7943 - RNA, 20 nt, Artificial Sequence
  spacer sequence
cuguggcacuuugcaugaac

SEQ ID NO: 7944 - RNA, 20 nt, Artificial Sequence
  spacer sequence
ugcaaagugccacagugaca

SEQ ID NO: 7945 - RNA, 20 nt, Artificial Sequence
  spacer sequence
uguuuaguucaugcaaagug

SEQ ID NO: 7946 - RNA, 20 nt, Artificial Sequence
  spacer sequence
cacaugaagaaaaagaugua

SEQ ID NO: 7947 - RNA, 20 nt, Artificial Sequence
  spacer sequence
ugugggaaaaguucauguuu

SEQ ID NO: 7948 - RNA, 20 nt, Artificial Sequence
  spacer sequence
ucaugugggaaaaguucaug

SEQ ID NO: 7949 - RNA, 20 nt, Artificial Sequence
  spacer sequence
uuuucuucaugugggaaaag

SEQ ID NO: 7950 - RNA, 20 nt, Artificial Sequence
  spacer sequence
accacucaucucuuucauca

SEQ ID NO: 7951 - RNA, 20 nt, Artificial Sequence
  spacer sequence
ucucuuucaucaauaccuga

SEQ ID NO: 7952 - RNA, 20 nt, Artificial Sequence
  spacer sequence
cuuucaucaauaccugaaga

SEQ ID NO: 7953 - RNA, 20 nt, Artificial Sequence
  spacer sequence
uucaucaauaccugaagauc

SEQ ID NO: 7954 - RNA, 20 nt, Artificial Sequence
  spacer sequence
ucaauaccugaagaucccua

SEQ ID NO: 7955 - RNA, 20 nt, Artificial Sequence
  spacer sequence
auaccugaagaucccuaagc

SEQ ID NO: 7956 - RNA, 20 nt, Artificial Sequence
  spacer sequence
gguauugaugaaagagauga

SEQ ID NO: 7957 - RNA, 20 nt, Artificial Sequence
  spacer sequence
ucagguauugaugaaagaga

SEQ ID NO: 7958 - RNA, 20 nt, Artificial Sequence
  spacer sequence
cuaagcauauaucccuaggu

SEQ ID NO: 7959 - RNA, 20 nt, Artificial Sequence
  spacer sequence
cuagguuuuuuuuuuaauca

SEQ ID NO: 7960 - RNA, 20 nt, Artificial Sequence
  spacer sequence
gcaaguauuauccuuuuucc

SEQ ID NO: 7961 - RNA, 20 nt, Artificial Sequence
  spacer sequence
uuuuuccauuucagaccugc

SEQ ID NO: 7962 - RNA, 20 nt, Artificial Sequence
  spacer sequence
auuucagaccugcagaaaac

SEQ ID NO: 7963 - RNA, 20 nt, Artificial Sequence
  spacer sequence
gaccugcagaaaacugaaau

SEQ ID NO: 7964 - RNA, 20 nt, Artificial Sequence
  spacer sequence
gaaauggaaaaaggauaaua

SEQ ID NO: 7965 - RNA, 20 nt, Artificial Sequence
  spacer sequence
gcaggucugaaauggaaaaa

SEQ ID NO: 7966 - RNA, 20 nt, Artificial Sequence
  spacer sequence
guuuucugcaggucugaaau

SEQ ID NO: 7967 - RNA, 20 nt, Artificial Sequence
  spacer sequence
uuugcauagauucaccaaua

SEQ ID NO: 7968 - RNA, 20 nt, Artificial Sequence
  spacer sequence
augcaaaggaaauaacaugu

SEQ ID NO: 7969 - RNA, 20 nt, Artificial Sequence
  spacer sequence
ccaauaacauuuaggccuau

SEQ ID NO: 7970 - RNA, 20 nt, Artificial Sequence
  spacer sequence
gaaaacacuccuggguuauu

SEQ ID NO: 7971 - RNA, 20 nt, Artificial Sequence
  spacer sequence
gaauaaauaggccuaaaugu

SEQ ID NO: 7972 - RNA, 20 nt, Artificial Sequence
  spacer sequence
uggguuauucuuauagaagg

SEQ ID NO: 7973 - RNA, 20 nt, Artificial Sequence
  spacer sequence
uauagaaggcacuauguucu

SEQ ID NO: 7974 - RNA, 20 nt, Artificial Sequence
  spacer sequence
auaagaauaacccaggagug

SEQ ID NO: 7975 - RNA, 20 nt, Artificial Sequence
  spacer sequence
gagagcugcggaaaauggaa

SEQ ID NO: 7976 - RNA, 20 nt, Artificial Sequence
  spacer sequence
gaacauagugccuucuauaa

SEQ ID NO: 7977 - RNA, 20 nt, Artificial Sequence
  spacer sequence
cagaacauagugccuucuau

SEQ ID NO: 7978 - RNA, 20 nt, Artificial Sequence
  spacer sequence
gcagcucucagaacauagug

SEQ ID NO: 7979 - RNA, 20 nt, Artificial Sequence
  spacer sequence
auuuuccgcagcucucagaa

SEQ ID NO: 7980 - RNA, 20 nt, Artificial Sequence
  spacer sequence
uccauuuuccgcagcucuca

SEQ ID NO: 7981 - RNA, 20 nt, Artificial Sequence
  spacer sequence
uuauucuuccauuuuccgca

SEQ ID NO: 7982 - RNA, 20 nt, Artificial Sequence
  spacer sequence
aagaaugagaaaaagcaucu

SEQ ID NO: 7983 - RNA, 20 nt, Artificial Sequence
  spacer sequence
uugaaaauuggcuccuuauu

SEQ ID NO: 7984 - RNA, 20 nt, Artificial Sequence
  spacer sequence
uucuuugaaaauuggcuccu

SEQ ID NO: 7985 - RNA, 20 nt, Artificial Sequence
  spacer sequence
cauucuuugaaaauuggcuc

SEQ ID NO: 7986 - RNA, 20 nt, Artificial Sequence
  spacer sequence
uucagauuguauuauacauu

SEQ ID NO: 7987 - RNA, 20 nt, Artificial Sequence
  spacer sequence
gauuguauuauacauuaaga

SEQ ID NO: 7988 - RNA, 20 nt, Artificial Sequence
  spacer sequence
gaaagaugcuuuuucucauu

SEQ ID NO: 7989 - RNA, 20 nt, Artificial Sequence
  spacer sequence
uaauguauaauacaaucuga

SEQ ID NO: 7990 - RNA, 20 nt, Artificial Sequence
  spacer sequence
uuuuuaaaauauaaucuuaa

SEQ ID NO: 7991 - RNA, 20 nt, Artificial Sequence
  spacer sequence
aagcaucauuuuuaaaauau

SEQ ID NO: 7992 - RNA, 20 nt, Artificial Sequence
  spacer sequence
ugcuaacauucuaagcauca

SEQ ID NO: 7993 - RNA, 20 nt, Artificial Sequence
  spacer sequence
cuugcuaacauucuaagcau

SEQ ID NO: 7994 - RNA, 20 nt, Artificial Sequence
  spacer sequence
uaagagaaauuugaguuuuc

SEQ ID NO: 7995 - RNA, 20 nt, Artificial Sequence
  spacer sequence
uaagaaucucuugcuaacau

SEQ ID NO: 7996 - RNA, 20 nt, Artificial Sequence
  spacer sequence
cuuaagaaucucuugcuaac

SEQ ID NO: 7997 - RNA, 20 nt, Artificial Sequence
  spacer sequence
aauuucucuuaagaaucucu

SEQ ID NO: 7998 - RNA, 20 nt, Artificial Sequence
  spacer sequence
auaauauauaaugcagauau

SEQ ID NO: 7999 - RNA, 20 nt, Artificial Sequence
  spacer sequence
gcauuauauauuauugaaaa

SEQ ID NO: 8000 - RNA, 20 nt, Artificial Sequence
  spacer sequence
guauaucugcauuauauauu

SEQ ID NO: 8001 - RNA, 20 nt, Artificial Sequence
  spacer sequence
caguauaucugcauuauaua

SEQ ID NO: 8002 - RNA, 20 nt, Artificial Sequence
  spacer sequence
caucucaguauaucugcauu

SEQ ID NO: 8003 - RNA, 20 nt, Artificial Sequence
  spacer sequence
ucuauuuuuggcauaagggu

SEQ ID NO: 8004 - RNA, 20 nt, Artificial Sequence
  spacer sequence
auuuuuggcauaaggguaua

SEQ ID NO: 8005 - RNA, 20 nt, Artificial Sequence
  spacer sequence
aaauauacccuuaugccaaa

SEQ ID NO: 8006 - RNA, 20 nt, Artificial Sequence
  spacer sequence
aauacaugaaaaacagaauu

SEQ ID NO: 8007 - RNA, 20 nt, Artificial Sequence
  spacer sequence
uguauuagauguuaucaaaa

SEQ ID NO: 8008 - RNA, 20 nt, Artificial Sequence
  spacer sequence
guuuuucauguauuagaugu

SEQ ID NO: 8009 - RNA, 20 nt, Artificial Sequence
  spacer sequence
cuuauaauucuguuuuucau

SEQ ID NO: 8010 - RNA, 20 nt, Artificial Sequence
  spacer sequence
aauuucacuuauaauucugu

SEQ ID NO: 8011 - RNA, 20 nt, Artificial Sequence
  spacer sequence
ccaauuucacuuauaauucu

SEQ ID NO: 8012 - RNA, 20 nt, Artificial Sequence
  spacer sequence
uucuccaauuucacuuauaa

SEQ ID NO: 8013 - RNA, 20 nt, Artificial Sequence
  spacer sequence
aaauaauguacaguaggcuc

SEQ ID NO: 8014 - RNA, 20 nt, Artificial Sequence
  spacer sequence
gcauggucaacuuccuacag

SEQ ID NO: 8015 - RNA, 20 nt, Artificial Sequence
  spacer sequence
acuuccuacagauuugcuuu

SEQ ID NO: 8016 - RNA, 20 nt, Artificial Sequence
  spacer sequence
uacagauuugcuuuuuggaa

SEQ ID NO: 8017 - RNA, 20 nt, Artificial Sequence
  spacer sequence
guaggaaguugaccaugcag

SEQ ID NO: 8018 - RNA, 20 nt, Artificial Sequence
  spacer sequence
aaaaagcaaaucuguaggaa

SEQ ID NO: 8019 - RNA, 20 nt, Artificial Sequence
  spacer sequence
guuagcauaauaauaauuac

SEQ ID NO: 8020 - RNA, 20 nt, Artificial Sequence
  spacer sequence
auuauaguaacauacuuaag

SEQ ID NO: 8021 - RNA, 20 nt, Artificial Sequence
  spacer sequence
uagcuauugcacuuugucaa

SEQ ID NO: 8022 - RNA, 20 nt, Artificial Sequence
  spacer sequence
cuauuagagucaauaaacuu

SEQ ID NO: 8023 - RNA, 20 nt, Artificial Sequence
  spacer sequence
aauagugaaauuuuaacuca

SEQ ID NO: 8024 - RNA, 20 nt, Artificial Sequence
  spacer sequence
auaaacuugaaaucuaaagu

SEQ ID NO: 8025 - RNA, 20 nt, Artificial Sequence
  spacer sequence
aguuuauugacucuaauagu

SEQ ID NO: 8026 - RNA, 20 nt, Artificial Sequence
  spacer sequence
aaaguuaacuuucuaucacu

SEQ ID NO: 8027 - RNA, 20 nt, Artificial Sequence
  spacer sequence
aucacugaaugagauuaucu

SEQ ID NO: 8028 - RNA, 20 nt, Artificial Sequence
  spacer sequence
cugaaugagauuaucuguag

SEQ ID NO: 8029 - RNA, 20 nt, Artificial Sequence
  spacer sequence
gugauagaaaguuaacuuua

SEQ ID NO: 8030 - RNA, 20 nt, Artificial Sequence
  spacer sequence
uucagugauagaaaguuaac

SEQ ID NO: 8031 - RNA, 20 nt, Artificial Sequence
  spacer sequence
cauucagugauagaaaguua

SEQ ID NO: 8032 - RNA, 20 nt, Artificial Sequence
  spacer sequence
guaggcaauuuuauuuucaa

SEQ ID NO: 8033 - RNA, 20 nt, Artificial Sequence
  spacer sequence
auauuagccggaaaaaaauc

SEQ ID NO: 8034 - RNA, 20 nt, Artificial Sequence
  spacer sequence
ggcuaauauugaaaauaaaa

SEQ ID NO: 8035 - RNA, 20 nt, Artificial Sequence
  spacer sequence
uaccugaaauucuuuacagc

SEQ ID NO: 8036 - RNA, 20 nt, Artificial Sequence
  spacer sequence
gguaagauuuuuuuccggcu

SEQ ID NO: 8037 - RNA, 20 nt, Artificial Sequence
  spacer sequence
uuacagcaauuaacuuuguc

SEQ ID NO: 8038 - RNA, 20 nt, Artificial Sequence
  spacer sequence
accaaaaucaaucuagagcc

SEQ ID NO: 8039 - RNA, 20 nt, Artificial Sequence
  spacer sequence
aucuagagcccagaguuacu

SEQ ID NO: 8040 - RNA, 20 nt, Artificial Sequence
  spacer sequence
agagcccagaguuacugccc

SEQ ID NO: 8041 - RNA, 20 nt, Artificial Sequence
  spacer sequence
agauugauuuugguagacaa

SEQ ID NO: 8042 - RNA, 20 nt, Artificial Sequence
  spacer sequence
gggcucuagauugauuuugg

SEQ ID NO: 8043 - RNA, 20 nt, Artificial Sequence
  spacer sequence
caccuuccucaagauguccc

SEQ ID NO: 8044 - RNA, 20 nt, Artificial Sequence
  spacer sequence
ucaagaugucccucagagag

SEQ ID NO: 8045 - RNA, 20 nt, Artificial Sequence
  spacer sequence
agaugucccucagagagauu

SEQ ID NO: 8046 - RNA, 20 nt, Artificial Sequence
  spacer sequence
ugaggaaggugggaggggca

SEQ ID NO: 8047 - RNA, 20 nt, Artificial Sequence
  spacer sequence
cucagagagauuuacauuua

SEQ ID NO: 8048 - RNA, 20 nt, Artificial Sequence
  spacer sequence
gagagauuuacauuuaagcc

SEQ ID NO: 8049 - RNA, 20 nt, Artificial Sequence
  spacer sequence
gagggacaucuugaggaagg

SEQ ID NO: 8050 - RNA, 20 nt, Artificial Sequence
  spacer sequence
cugagggacaucuugaggaa

SEQ ID NO: 8051 - RNA, 20 nt, Artificial Sequence
  spacer sequence
cucugagggacaucuugagg

SEQ ID NO: 8052 - RNA, 20 nt, Artificial Sequence
  spacer sequence
ucagacuugcacucuggagc

SEQ ID NO: 8053 - RNA, 20 nt, Artificial Sequence
  spacer sequence
gacuugcacucuggagcagc

SEQ ID NO: 8054 - RNA, 20 nt, Artificial Sequence
  spacer sequence
gaagaauggcuuaaauguaa

SEQ ID NO: 8055 - RNA, 20 nt, Artificial Sequence
  spacer sequence
ggagcagccuaacaagugac

SEQ ID NO: 8056 - RNA, 20 nt, Artificial Sequence
  spacer sequence
agagugcaagucugaagaau

SEQ ID NO: 8057 - RNA, 20 nt, Artificial Sequence
  spacer sequence
cuuguuaggcugcuccagag

SEQ ID NO: 8058 - RNA, 20 nt, Artificial Sequence
  spacer sequence
ugggcugucacuuguuaggc

SEQ ID NO: 8059 - RNA, 20 nt, Artificial Sequence
  spacer sequence
ccugggcugucacuuguuag

SEQ ID NO: 8060 - RNA, 20 nt, Artificial Sequence
  spacer sequence
auuucuccugggcugucacu

SEQ ID NO: 8061 - RNA, 20 nt, Artificial Sequence
  spacer sequence
ccauuucuccugggcuguca

SEQ ID NO: 8062 - RNA, 20 nt, Artificial Sequence
  spacer sequence
agguuuucugcaagacuuuc

SEQ ID NO: 8063 - RNA, 20 nt, Artificial Sequence
  spacer sequence
gcaagacuuucuccauguuu

SEQ ID NO: 8064 - RNA, 20 nt, Artificial Sequence
  spacer sequence
ugcagaaaaccuugaaaugu

SEQ ID NO: 8065 - RNA, 20 nt, Artificial Sequence
  spacer sequence
ccauguuucauuugaagugc

SEQ ID NO: 8066 - RNA, 20 nt, Artificial Sequence
  spacer sequence
auguuucauuugaagugcuu

SEQ ID NO: 8067 - RNA, 20 nt, Artificial Sequence
  spacer sequence
uuugaagugcuuugccuugg

SEQ ID NO: 8068 - RNA, 20 nt, Artificial Sequence
  spacer sequence
aaugaaacauggagaaaguc

SEQ ID NO: 8069 - RNA, 20 nt, Artificial Sequence
  spacer sequence
caaggcaaagcacuucaaau

SEQ ID NO: 8070 - RNA, 20 nt, Artificial Sequence
  spacer sequence
cccaaggcaaagcacuucaa

SEQ ID NO: 8071 - RNA, 20 nt, Artificial Sequence
  spacer sequence
uguguaaauucauauccacg

SEQ ID NO: 8072 - RNA, 20 nt, Artificial Sequence
  spacer sequence
uauccacgccaaguauuugu

SEQ ID NO: 8073 - RNA, 20 nt, Artificial Sequence
  spacer sequence
acgccaaguauuuguucuag

SEQ ID NO: 8074 - RNA, 20 nt, Artificial Sequence
  spacer sequence
agauuaaucacuauuuugca

SEQ ID NO: 8075 - RNA, 20 nt, Artificial Sequence
  spacer sequence
agaacaaauacuuggcgugg

SEQ ID NO: 8076 - RNA, 20 nt, Artificial Sequence
  spacer sequence
cuauuuugcauuauccacug

SEQ ID NO: 8077 - RNA, 20 nt, Artificial Sequence
  spacer sequence
acuguauccaaugaacaagg

SEQ ID NO: 8078 - RNA, 20 nt, Artificial Sequence
  spacer sequence
aaugaacaagguuauauacu

SEQ ID NO: 8079 - RNA, 20 nt, Artificial Sequence
  spacer sequence
uuggauacaguggauaaugc

SEQ ID NO: 8080 - RNA, 20 nt, Artificial Sequence
  spacer sequence
acuuaguauauaaccuuguu

SEQ ID NO: 8081 - RNA, 20 nt, Artificial Sequence
  spacer sequence
uauuuaagaaccauuucuac

SEQ ID NO: 8082 - RNA, 20 nt, Artificial Sequence
  spacer sequence
uaaauacgaauuacaguacc

SEQ ID NO: 8083 - RNA, 20 nt, Artificial Sequence
  spacer sequence
acuauauaacacuaguggaa

SEQ ID NO: 8084 - RNA, 20 nt, Artificial Sequence
  spacer sequence
acuaguguuauauaguagaa

SEQ ID NO: 8085 - RNA, 20 nt, Artificial Sequence
  spacer sequence
aauuauuguauuaauguuau

SEQ ID NO: 8086 - RNA, 20 nt, Artificial Sequence
  spacer sequence
aauauuuuaaagcuuucaaa

SEQ ID NO: 8087 - RNA, 20 nt, Artificial Sequence
  spacer sequence
aagaagaacacuuuuauagg

SEQ ID NO: 8088 - RNA, 20 nt, Artificial Sequence
  spacer sequence
uugaaagcuuuaaaauauuu

SEQ ID NO: 8089 - RNA, 20 nt, Artificial Sequence
  spacer sequence
ucuuugaaagcuuuaaaaua

SEQ ID NO: 8090 - RNA, 20 nt, Artificial Sequence
  spacer sequence
uauaaaaguguucuucuuug

SEQ ID NO: 8091 - RNA, 20 nt, Artificial Sequence
  spacer sequence
gguauuuaauuugguaccca

SEQ ID NO: 8092 - RNA, 20 nt, Artificial Sequence
  spacer sequence
cucuagcuuauaauuuaaug

SEQ ID NO: 8093 - RNA, 20 nt, Artificial Sequence
  spacer sequence
agcuuauaauuuaauguaac

SEQ ID NO: 8094 - RNA, 20 nt, Artificial Sequence
  spacer sequence
aaauucaaacaaaauuaaaa

SEQ ID NO: 8095 - RNA, 20 nt, Artificial Sequence
  spacer sequence
aacaaaauuaaaacacaaaa

SEQ ID NO: 8096 - RNA, 20 nt, Artificial Sequence
  spacer sequence
aaguacuaacauaauacgua

SEQ ID NO: 8097 - RNA, 20 nt, Artificial Sequence
  spacer sequence
acuuucuagaauuuucuuca

SEQ ID NO: 8098 - RNA, 20 nt, Artificial Sequence
  spacer sequence
agaauuuucuucaggcuucc

SEQ ID NO: 8099 - RNA, 20 nt, Artificial Sequence
  spacer sequence
agaaaguagaguuuucaaag

SEQ ID NO: 8100 - RNA, 20 nt, Artificial Sequence
  spacer sequence
ucaggcuuccuuuuaauguc

SEQ ID NO: 8101 - RNA, 20 nt, Artificial Sequence
  spacer sequence
ggcuuccuuuuaaugucagu

SEQ ID NO: 8102 - RNA, 20 nt, Artificial Sequence
  spacer sequence
uuuuaaugucaguggcuaac

SEQ ID NO: 8103 - RNA, 20 nt, Artificial Sequence
  spacer sequence
guggcuaacuagugcauuac

SEQ ID NO: 8104 - RNA, 20 nt, Artificial Sequence
  spacer sequence
acuaguaaugcacuaguuag

SEQ ID NO: 8105 - RNA, 20 nt, Artificial Sequence
  spacer sequence
aguaaguguugcuaaaaaug

SEQ ID NO: 8106 - RNA, 20 nt, Artificial Sequence
  spacer sequence
uuuuuagcaacacuuacuag

SEQ ID NO: 8107 - RNA, 20 nt, Artificial Sequence
  spacer sequence
aaaauucuagacagaaacug

SEQ ID NO: 8108 - RNA, 20 nt, Artificial Sequence
  spacer sequence
agacagaaacugggcaaaga

SEQ ID NO: 8109 - RNA, 20 nt, Artificial Sequence
  spacer sequence
agaauuuuagauuuuuuagu

SEQ ID NO: 8110 - RNA, 20 nt, Artificial Sequence
  spacer sequence
gucuagaauuuuagauuuuu

SEQ ID NO: 8111 - RNA, 20 nt, Artificial Sequence
  spacer sequence
uugcccaguuucugucuaga

SEQ ID NO: 8112 - RNA, 20 nt, Artificial Sequence
  spacer sequence
aaacuuaagugaaaucauca

SEQ ID NO: 8113 - RNA, 20 nt, Artificial Sequence
  spacer sequence
cuuaaguuuggauuucuuug

SEQ ID NO: 8114 - RNA, 20 nt, Artificial Sequence
  spacer sequence
ucaaaaucaaauuccuauug

SEQ ID NO: 8115 - RNA, 20 nt, Artificial Sequence
  spacer sequence
aaaucaaauuccuauugaua

SEQ ID NO: 8116 - RNA, 20 nt, Artificial Sequence
  spacer sequence
aauuccuauugauauugcug

SEQ ID NO: 8117 - RNA, 20 nt, Artificial Sequence
  spacer sequence
uauugauauugcuggcaaag

SEQ ID NO: 8118 - RNA, 20 nt, Artificial Sequence
  spacer sequence
auaggaauuugauuuugaug

SEQ ID NO: 8119 - RNA, 20 nt, Artificial Sequence
  spacer sequence
ucuuuuaggcaguuucaggg

SEQ ID NO: 8120 - RNA, 20 nt, Artificial Sequence
  spacer sequence
uuuaggcaguuucagggauc

SEQ ID NO: 8121 - RNA, 20 nt, Artificial Sequence
  spacer sequence
gggaucauaacgauagcaua

SEQ ID NO: 8122 - RNA, 20 nt, Artificial Sequence
  spacer sequence
cugaaacugccuaaaagaug

SEQ ID NO: 8123 - RNA, 20 nt, Artificial Sequence
  spacer sequence
uaacgauagcauaaaaacau

SEQ ID NO: 8124 - RNA, 20 nt, Artificial Sequence
  spacer sequence
uuaugaucccugaaacugcc

SEQ ID NO: 8125 - RNA, 20 nt, Artificial Sequence
  spacer sequence
caaaccaauucuguccccac

SEQ ID NO: 8126 - RNA, 20 nt, Artificial Sequence
  spacer sequence
guccccacaauuuccugagg

SEQ ID NO: 8127 - RNA, 20 nt, Artificial Sequence
  spacer sequence
ccacaauuuccugagguguc

SEQ ID NO: 8128 - RNA, 20 nt, Artificial Sequence
  spacer sequence
ugagguguccaaaucuggaa

SEQ ID NO: 8129 - RNA, 20 nt, Artificial Sequence
  spacer sequence
ggaaauuguggggacagaau

SEQ ID NO: 8130 - RNA, 20 nt, Artificial Sequence
  spacer sequence
aaaucuggaaucaucaacuc

SEQ ID NO: 8131 - RNA, 20 nt, Artificial Sequence
  spacer sequence
ggaaucaucaacucaaaugu

SEQ ID NO: 8132 - RNA, 20 nt, Artificial Sequence
  spacer sequence
agauuuggacaccucaggaa

SEQ ID NO: 8133 - RNA, 20 nt, Artificial Sequence
  spacer sequence
ucaacucaaaugucuacuga

SEQ ID NO: 8134 - RNA, 20 nt, Artificial Sequence
  spacer sequence
acucaaaugucuacugaagc

SEQ ID NO: 8135 - RNA, 20 nt, Artificial Sequence
  spacer sequence
aaugucuacugaagccaugc

SEQ ID NO: 8136 - RNA, 20 nt, Artificial Sequence
  spacer sequence
acugaagccaugccaggacu

SEQ ID NO: 8137 - RNA, 20 nt, Artificial Sequence
  spacer sequence
guagacauuugaguugauga

SEQ ID NO: 8138 - RNA, 20 nt, Artificial Sequence
  spacer sequence
uggcauggcuucaguagaca

SEQ ID NO: 8139 - RNA, 20 nt, Artificial Sequence
  spacer sequence
ugcuuuaaaaccuuugguaa

SEQ ID NO: 8140 - RNA, 20 nt, Artificial Sequence
  spacer sequence
uacuuguaauuuuuguuacc

SEQ ID NO: 8141 - RNA, 20 nt, Artificial Sequence
  spacer sequence
cuuccuacuuguaauuuuug

SEQ ID NO: 8142 - RNA, 20 nt, Artificial Sequence
  spacer sequence
uacaaauacucaacucuuau

SEQ ID NO: 8143 - RNA, 20 nt, Artificial Sequence
  spacer sequence
acucuuauuuauaaauuuua

SEQ ID NO: 8144 - RNA, 20 nt, Artificial Sequence
  spacer sequence
uauuuauaaauuuuaccauc

SEQ ID NO: 8145 - RNA, 20 nt, Artificial Sequence
  spacer sequence
gcuacaguagugugacaaaa

SEQ ID NO: 8146 - RNA, 20 nt, Artificial Sequence
  spacer sequence
cacuacuguagcugauggua

SEQ ID NO: 8147 - RNA, 20 nt, Artificial Sequence
  spacer sequence
cuucauauugauaauuaaug

SEQ ID NO: 8148 - RNA, 20 nt, Artificial Sequence
  spacer sequence
ucauauugauaauuaaugaa

SEQ ID NO: 8149 - RNA, 20 nt, Artificial Sequence
  spacer sequence
uauugauaauuaaugaauaa

SEQ ID NO: 8150 - RNA, 20 nt, Artificial Sequence
  spacer sequence
auaugaagagauuaccacca

SEQ ID NO: 8151 - RNA, 20 nt, Artificial Sequence
  spacer sequence
uuaauuaucaauaugaagag

SEQ ID NO: 8152 - RNA, 20 nt, Artificial Sequence
  spacer sequence
agaggcuuuaauuuuccaua

SEQ ID NO: 8153 - RNA, 20 nt, Artificial Sequence
  spacer sequence
ugacaaguauguuuauucau

SEQ ID NO: 8154 - RNA, 20 nt, Artificial Sequence
  spacer sequence
auaaaaggaaugaguucgac

SEQ ID NO: 8155 - RNA, 20 nt, Artificial Sequence
  spacer sequence
uuuuauggaaaauuaaagcc

SEQ ID NO: 8156 - RNA, 20 nt, Artificial Sequence
  spacer sequence
uuccuuuuauggaaaauuaa

SEQ ID NO: 8157 - RNA, 20 nt, Artificial Sequence
  spacer sequence
accuagaacaguuuuugcuu

SEQ ID NO: 8158 - RNA, 20 nt, Artificial Sequence
  spacer sequence
aacucauuccuuuuauggaa

SEQ ID NO: 8159 - RNA, 20 nt, Artificial Sequence
  spacer sequence
aggucgaacucauuccuuuu

SEQ ID NO: 8160 - RNA, 20 nt, Artificial Sequence
  spacer sequence
agcaaaaacuguucuagguc

SEQ ID NO: 8161 - RNA, 20 nt, Artificial Sequence
  spacer sequence
uuucaagcaaaaacuguucu

SEQ ID NO: 8162 - RNA, 20 nt, Artificial Sequence
  spacer sequence
aaaauaucuuuucaagcaaa

SEQ ID NO: 8163 - RNA, 20 nt, Artificial Sequence
  spacer sequence
guacuguguuaccaguauau

SEQ ID NO: 8164 - RNA, 20 nt, Artificial Sequence
  spacer sequence
uuuuuauuguuuggaacacc

SEQ ID NO: 8165 - RNA, 20 nt, Artificial Sequence
  spacer sequence
aaacaauaaaaaagaauaca

SEQ ID NO: 8166 - RNA, 20 nt, Artificial Sequence
  spacer sequence
uuguaaauguaaaguuuggg

SEQ ID NO: 8167 - RNA, 20 nt, Artificial Sequence
  spacer sequence
aauauguacaaccuauuuuu

SEQ ID NO: 8168 - RNA, 20 nt, Artificial Sequence
  spacer sequence
cuaauauguacaaccuauuu

SEQ ID NO: 8169 - RNA, 20 nt, Artificial Sequence
  spacer sequence
aaaacuuuuguauaacaugu

SEQ ID NO: 8170 - RNA, 20 nt, Artificial Sequence
  spacer sequence
uuacuguauaaguguuugug

SEQ ID NO: 8171 - RNA, 20 nt, Artificial Sequence
  spacer sequence
cuuuacuguauaaguguuug

SEQ ID NO: 8172 - RNA, 20 nt, Artificial Sequence
  spacer sequence
uucucuuuacuguauaagug

SEQ ID NO: 8173 - RNA, 20 nt, Artificial Sequence
  spacer sequence
guucauucucuuuacuguau

SEQ ID NO: 8174 - RNA, 20 nt, Artificial Sequence
  spacer sequence
uuuguaauauuccuucucuc

SEQ ID NO: 8175 - RNA, 20 nt, Artificial Sequence
  spacer sequence
uucucuccuaagugaccaac

SEQ ID NO: 8176 - RNA, 20 nt, Artificial Sequence
  spacer sequence
cuccuaagugaccaacaacu

SEQ ID NO: 8177 - RNA, 20 nt, Artificial Sequence
  spacer sequence
ccuaagugaccaacaacugu

SEQ ID NO: 8178 - RNA, 20 nt, Artificial Sequence
  spacer sequence
uaagugaccaacaacuguag

SEQ ID NO: 8179 - RNA, 20 nt, Artificial Sequence
  spacer sequence
cuuaggagagaaggaauauu

SEQ ID NO: 8180 - RNA, 20 nt, Artificial Sequence
  spacer sequence
acaguuguuggucacuuagg

SEQ ID NO: 8181 - RNA, 20 nt, Artificial Sequence
  spacer sequence
uaaaagcuaaagguaacauu

SEQ ID NO: 8182 - RNA, 20 nt, Artificial Sequence
  spacer sequence
cacacccaaauagcuacagu

SEQ ID NO: 8183 - RNA, 20 nt, Artificial Sequence
  spacer sequence
cacacacccaaauagcuaca

SEQ ID NO: 8184 - RNA, 20 nt, Artificial Sequence
  spacer sequence
uuaaaaucaaguaauaauua

SEQ ID NO: 8185 - RNA, 20 nt, Artificial Sequence
  spacer sequence
aguaauaauuauugcgcauc

SEQ ID NO: 8186 - RNA, 20 nt, Artificial Sequence
  spacer sequence
aguaauuuuauauuuucaga

SEQ ID NO: 8187 - RNA, 20 nt, Artificial Sequence
  spacer sequence
gauuaucaguauuacuaaaa

SEQ ID NO: 8188 - RNA, 20 nt, Artificial Sequence
  spacer sequence
gaaaauauaaaauuacuuga

SEQ ID NO: 8189 - RNA, 20 nt, Artificial Sequence
  spacer sequence
guauuacuaaaagaaucaaa

SEQ ID NO: 8190 - RNA, 20 nt, Artificial Sequence
  spacer sequence
uuuaguaauacugauaaucu

SEQ ID NO: 8191 - RNA, 20 nt, Artificial Sequence
  spacer sequence
aaaucucuaaaaguugguuu

SEQ ID NO: 8192 - RNA, 20 nt, Artificial Sequence
  spacer sequence
cuaaaaguugguuuuauucc

SEQ ID NO: 8193 - RNA, 20 nt, Artificial Sequence
  spacer sequence
aaaaguugguuuuauucccu

SEQ ID NO: 8194 - RNA, 20 nt, Artificial Sequence
  spacer sequence
cuccaaauucaguaguacaa

SEQ ID NO: 8195 - RNA, 20 nt, Artificial Sequence
  spacer sequence
aaauucaguaguacaacuca

SEQ ID NO: 8196 - RNA, 20 nt, Artificial Sequence
  spacer sequence
guaguacaacucaacuaauu

SEQ ID NO: 8197 - RNA, 20 nt, Artificial Sequence
  spacer sequence
acuaauuacucccaaacuaa

SEQ ID NO: 8198 - RNA, 20 nt, Artificial Sequence
  spacer sequence
caaacuaacacccgcacuua

SEQ ID NO: 8199 - RNA, 20 nt, Artificial Sequence
  spacer sequence
gaugauacaaccaaaccauc

SEQ ID NO: 8200 - RNA, 20 nt, Artificial Sequence
  spacer sequence
gacuuaagugcggguguuag

SEQ ID NO: 8201 - RNA, 20 nt, Artificial Sequence
  spacer sequence
ucagacuuaagugcgggugu

SEQ ID NO: 8202 - RNA, 20 nt, Artificial Sequence
  spacer sequence
uuaaggcacccacugccucu

SEQ ID NO: 8203 - RNA, 20 nt, Artificial Sequence
  spacer sequence
uuccaguauaaucaggcuuc

SEQ ID NO: 8204 - RNA, 20 nt, Artificial Sequence
  spacer sequence
aguauaaucaggcuucacua

SEQ ID NO: 8205 - RNA, 20 nt, Artificial Sequence
  spacer sequence
ggcuucacuacagaauuuuu

SEQ ID NO: 8206 - RNA, 20 nt, Artificial Sequence
  spacer sequence
cuacagaauuuuuggagacc

SEQ ID NO: 8207 - RNA, 20 nt, Artificial Sequence
  spacer sequence
guagugaagccugauuauac

SEQ ID NO: 8208 - RNA, 20 nt, Artificial Sequence
  spacer sequence
aaaaauucuguagugaagcc

SEQ ID NO: 8209 - RNA, 20 nt, Artificial Sequence
  spacer sequence
ccaaaaauucuguagugaag

SEQ ID NO: 8210 - RNA, 20 nt, Artificial Sequence
  spacer sequence
gugggucuccaaaaauucug

SEQ ID NO: 8211 - RNA, 20 nt, Artificial Sequence
  spacer sequence
caaauuaagauccaagaacu

SEQ ID NO: 8212 - RNA, 20 nt, Artificial Sequence
  spacer sequence
uaauuugugaaauguggcaa

SEQ ID NO: 8213 - RNA, 20 nt, Artificial Sequence
  spacer sequence
aagaacucaguuaagucucg

SEQ ID NO: 8214 - RNA, 20 nt, Artificial Sequence
  spacer sequence
uggaucuuaauuugugaaau

SEQ ID NO: 8215 - RNA, 20 nt, Artificial Sequence
  spacer sequence
guuaagucucgcucacugga

SEQ ID NO: 8216 - RNA, 20 nt, Artificial Sequence
  spacer sequence
cgcucacuggaaaaacuaca

SEQ ID NO: 8217 - RNA, 20 nt, Artificial Sequence
  spacer sequence
cucacuggaaaaacuacaga

SEQ ID NO: 8218 - RNA, 20 nt, Artificial Sequence
  spacer sequence
cuggaaaaacuacagauauc

SEQ ID NO: 8219 - RNA, 20 nt, Artificial Sequence
  spacer sequence
agugagcgagacuuaacuga

SEQ ID NO: 8220 - RNA, 20 nt, Artificial Sequence
  spacer sequence
guaguuuuuccagugagcga

SEQ ID NO: 8221 - RNA, 20 nt, Artificial Sequence
  spacer sequence
aguaggugugcuauuuauca

SEQ ID NO: 8222 - RNA, 20 nt, Artificial Sequence
  spacer sequence
cuaaacugacacauuuucuc

SEQ ID NO: 8223 - RNA, 20 nt, Artificial Sequence
  spacer sequence
guuuagugauaaauagcaca

SEQ ID NO: 8224 - RNA, 20 nt, Artificial Sequence
  spacer sequence
cauuaagccaacugauggaa

SEQ ID NO: 8225 - RNA, 20 nt, Artificial Sequence
  spacer sequence
uuaagccaacugauggaacu

SEQ ID NO: 8226 - RNA, 20 nt, Artificial Sequence
  spacer sequence
guuggcuuaaugagaaaaug

SEQ ID NO: 8227 - RNA, 20 nt, Artificial Sequence
  spacer sequence
aucaguuggcuuaaugagaa

SEQ ID NO: 8228 - RNA, 20 nt, Artificial Sequence
  spacer sequence
uaaauuuacacauauuaaag

SEQ ID NO: 8229 - RNA, 20 nt, Artificial Sequence
  spacer sequence
aaucuaucucgaaaauaucu

SEQ ID NO: 8230 - RNA, 20 nt, Artificial Sequence
  spacer sequence
aucucgaaaauaucugaggc

SEQ ID NO: 8231 - RNA, 20 nt, Artificial Sequence
  spacer sequence
cgaaaauaucugaggcaacu

SEQ ID NO: 8232 - RNA, 20 nt, Artificial Sequence
  spacer sequence
aaaauaucugaggcaacuau

SEQ ID NO: 8233 - RNA, 20 nt, Artificial Sequence
  spacer sequence
agauagauuagaucauaaau

SEQ ID NO: 8234 - RNA, 20 nt, Artificial Sequence
  spacer sequence
gaggcaacuaugucaagaua

SEQ ID NO: 8235 - RNA, 20 nt, Artificial Sequence
  spacer sequence
gauauuuucgagauagauua

SEQ ID NO: 8236 - RNA, 20 nt, Artificial Sequence
  spacer sequence
agauaaauuuuuuccuaaaa

SEQ ID NO: 8237 - RNA, 20 nt, Artificial Sequence
  spacer sequence
ugacauaguugccucagaua

SEQ ID NO: 8238 - RNA, 20 nt, Artificial Sequence
  spacer sequence
uaaaaaguaggccaggugcg

SEQ ID NO: 8239 - RNA, 20 nt, Artificial Sequence
  spacer sequence
cgaggucaagagaucaagac

SEQ ID NO: 8240 - RNA, 20 nt, Artificial Sequence
  spacer sequence
ugagccaccgcaccuggccu

SEQ ID NO: 8241 - RNA, 20 nt, Artificial Sequence
  spacer sequence
agagaucaagaccauccugg

SEQ ID NO: 8242 - RNA, 20 nt, Artificial Sequence
  spacer sequence
ugaccucgugagccaccgca

SEQ ID NO: 8243 - RNA, 20 nt, Artificial Sequence
  spacer sequence
cuugaccucgugagccaccg

SEQ ID NO: 8244 - RNA, 20 nt, Artificial Sequence
  spacer sequence
agaccauccuggccaacaug

SEQ ID NO: 8245 - RNA, 20 nt, Artificial Sequence
  spacer sequence
ugaucucuugaccucgugag

SEQ ID NO: 8246 - RNA, 20 nt, Artificial Sequence
  spacer sequence
uggccaacauggugaaaccc

SEQ ID NO: 8247 - RNA, 20 nt, Artificial Sequence
  spacer sequence
ccauguuggccaggaugguc

SEQ ID NO: 8248 - RNA, 20 nt, Artificial Sequence
  spacer sequence
cuacuaaaaauagaaaaauc

SEQ ID NO: 8249 - RNA, 20 nt, Artificial Sequence
  spacer sequence
acuaaaaauagaaaaaucag

SEQ ID NO: 8250 - RNA, 20 nt, Artificial Sequence
  spacer sequence
auuuuuaguagagacagggu

SEQ ID NO: 8251 - RNA, 20 nt, Artificial Sequence
  spacer sequence
gcugggcgugguggcacgcg

SEQ ID NO: 8252 - RNA, 20 nt, Artificial Sequence
  spacer sequence
cagcuacuuggaaggcugag

SEQ ID NO: 8253 - RNA, 20 nt, Artificial Sequence
  spacer sequence
aaguagcugggacuacaggc

SEQ ID NO: 8254 - RNA, 20 nt, Artificial Sequence
  spacer sequence
gccuuccaaguagcugggac

SEQ ID NO: 8255 - RNA, 20 nt, Artificial Sequence
  spacer sequence
ugccucagccuuccaaguag

SEQ ID NO: 8256 - RNA, 20 nt, Artificial Sequence
  spacer sequence
cgugccucagccuuccaagu

SEQ ID NO: 8257 - RNA, 20 nt, Artificial Sequence
  spacer sequence
cuugaacuugggaggcggag

SEQ ID NO: 8258 - RNA, 20 nt, Artificial Sequence
  spacer sequence
agcgauucucgugccucagc

SEQ ID NO: 8259 - RNA, 20 nt, Artificial Sequence
  spacer sequence
caaguucaagcgauucucgu

SEQ ID NO: 8260 - RNA, 20 nt, Artificial Sequence
  spacer sequence
gccucccaaguucaagcgau

SEQ ID NO: 8261 - RNA, 20 nt, Artificial Sequence
  spacer sequence
cugcagccuccgccucccaa

SEQ ID NO: 8262 - RNA, 20 nt, Artificial Sequence
  spacer sequence
cacugcagccuccgccuccc

SEQ ID NO: 8263 - RNA, 20 nt, Artificial Sequence
  spacer sequence
ucucacugcagccuccgccu

SEQ ID NO: 8264 - RNA, 20 nt, Artificial Sequence
  spacer sequence
caucucacugcagccuccgc

SEQ ID NO: 8265 - RNA, 20 nt, Artificial Sequence
  spacer sequence
aaccuggcgacagagugaga

SEQ ID NO: 8266 - RNA, 20 nt, Artificial Sequence
  spacer sequence
ccagguuggagugcaguggc

SEQ ID NO: 8267 - RNA, 20 nt, Artificial Sequence
  spacer sequence
gucgccagguuggagugcag

SEQ ID NO: 8268 - RNA, 20 nt, Artificial Sequence
  spacer sequence
cucugucgccagguuggagu

SEQ ID NO: 8269 - RNA, 20 nt, Artificial Sequence
  spacer sequence
cacucugucgccagguugga

SEQ ID NO: 8270 - RNA, 20 nt, Artificial Sequence
  spacer sequence
caaaaaaaaaaaaaaguuug

SEQ ID NO: 8271 - RNA, 20 nt, Artificial Sequence
  spacer sequence
aaaaaaaaaaaaaguuugcu

SEQ ID NO: 8272 - RNA, 20 nt, Artificial Sequence
  spacer sequence
ucugucugccaauauaacag

SEQ ID NO: 8273 - RNA, 20 nt, Artificial Sequence
  spacer sequence
gucugccaauauaacaguuu

SEQ ID NO: 8274 - RNA, 20 nt, Artificial Sequence
  spacer sequence
gccaauauaacaguuuaaaa

SEQ ID NO: 8275 - RNA, 20 nt, Artificial Sequence
  spacer sequence
uuuuaaacuguuauauuggc

SEQ ID NO: 8276 - RNA, 20 nt, Artificial Sequence
  spacer sequence
cagaugaaguaauguaauuu

SEQ ID NO: 8277 - RNA, 20 nt, Artificial Sequence
  spacer sequence
gugauucguuuuaaacuguu

SEQ ID NO: 8278 - RNA, 20 nt, Artificial Sequence
  spacer sequence
ucugugauucguuuuaaacu

SEQ ID NO: 8279 - RNA, 20 nt, Artificial Sequence
  spacer sequence
aaaauuacauuacuucaucu

SEQ ID NO: 8280 - RNA, 20 nt, Artificial Sequence
  spacer sequence
uuugcaauucuaaaauuaca

SEQ ID NO: 8281 - RNA, 20 nt, Artificial Sequence
  spacer sequence
ucucuaggucuuauaaauaa

SEQ ID NO: 8282 - RNA, 20 nt, Artificial Sequence
  spacer sequence
cuaggucuuauaaauaacau

SEQ ID NO: 8283 - RNA, 20 nt, Artificial Sequence
  spacer sequence
aggucuuauaaauaacaucu

SEQ ID NO: 8284 - RNA, 20 nt, Artificial Sequence
  spacer sequence
uauaaauaacaucuaugaca

SEQ ID NO: 8285 - RNA, 20 nt, Artificial Sequence
  spacer sequence
augacauuucuuaccuguaa

SEQ ID NO: 8286 - RNA, 20 nt, Artificial Sequence
  spacer sequence
uagauguuauuuauaagacc

SEQ ID NO: 8287 - RNA, 20 nt, Artificial Sequence
  spacer sequence
uaccuguaauauaagcaccc

SEQ ID NO: 8288 - RNA, 20 nt, Artificial Sequence
  spacer sequence
cuaagugccugcccuacagc

SEQ ID NO: 8289 - RNA, 20 nt, Artificial Sequence
  spacer sequence
auaaaacacuugcuuugggg

SEQ ID NO: 8290 - RNA, 20 nt, Artificial Sequence
  spacer sequence
ucgugacaccauuguguuug

SEQ ID NO: 8291 - RNA, 20 nt, Artificial Sequence
  spacer sequence
ugacaccauuguguuuguca

SEQ ID NO: 8292 - RNA, 20 nt, Artificial Sequence
  spacer sequence
cgaugauuuaaugggcuaac

SEQ ID NO: 8293 - RNA, 20 nt, Artificial Sequence
  spacer sequence
uuuuucucccccuuuagaga

SEQ ID NO: 8294 - RNA, 20 nt, Artificial Sequence
  spacer sequence
cccccuuuagagaugagaaa

SEQ ID NO: 8295 - RNA, 20 nt, Artificial Sequence
  spacer sequence
cccuuuagagaugagaaaac

SEQ ID NO: 8296 - RNA, 20 nt, Artificial Sequence
  spacer sequence
aaagggggagaaaaaugaca

SEQ ID NO: 8297 - RNA, 20 nt, Artificial Sequence
  spacer sequence
cuaaagggggagaaaaauga

SEQ ID NO: 8298 - RNA, 20 nt, Artificial Sequence
  spacer sequence
ucucuaaagggggagaaaaa

SEQ ID NO: 8299 - RNA, 20 nt, Artificial Sequence
  spacer sequence
caucucuaaagggggagaaa

SEQ ID NO: 8300 - RNA, 20 nt, Artificial Sequence
  spacer sequence
guuuucucaucucuaaaggg

SEQ ID NO: 8301 - RNA, 20 nt, Artificial Sequence
  spacer sequence
acuucuagacuuauaguuuu

SEQ ID NO: 8302 - RNA, 20 nt, Artificial Sequence
  spacer sequence
agacuuauaguuuucuggug

SEQ ID NO: 8303 - RNA, 20 nt, Artificial Sequence
  spacer sequence
agaaguugaugcuaaacuuc

SEQ ID NO: 8304 - RNA, 20 nt, Artificial Sequence
  spacer sequence
ggugagcauaacaauuccuu

SEQ ID NO: 8305 - RNA, 20 nt, Artificial Sequence
  spacer sequence
ccagaaaacuauaagucuag

SEQ ID NO: 8306 - RNA, 20 nt, Artificial Sequence
  spacer sequence
uuuuauuaucuuaaaagaaa

SEQ ID NO: 8307 - RNA, 20 nt, Artificial Sequence
  spacer sequence
uaaaagaaaacauuagagca

SEQ ID NO: 8308 - RNA, 20 nt, Artificial Sequence
  spacer sequence
uuuaagauaauaaaaggaau

SEQ ID NO: 8309 - RNA, 20 nt, Artificial Sequence
  spacer sequence
aauguuuucuuuuaagauaa

SEQ ID NO: 8310 - RNA, 20 nt, Artificial Sequence
  spacer sequence
uggugcucuaauguuuucuu

SEQ ID NO: 8311 - RNA, 20 nt, Artificial Sequence
  spacer sequence
ucuuggugcucuaauguuuu

SEQ ID NO: 8312 - RNA, 20 nt, Artificial Sequence
  spacer sequence
uaguucugggauuccaucac

SEQ ID NO: 8313 - RNA, 20 nt, Artificial Sequence
  spacer sequence
gggauuccaucacuuguuau

SEQ ID NO: 8314 - RNA, 20 nt, Artificial Sequence
  spacer sequence
cagaacuaagaugcuuuggu

SEQ ID NO: 8315 - RNA, 20 nt, Artificial Sequence
  spacer sequence
aucacuuguuaucccaaccu

SEQ ID NO: 8316 - RNA, 20 nt, Artificial Sequence
  spacer sequence
cuuguuaucccaaccuaauu

SEQ ID NO: 8317 - RNA, 20 nt, Artificial Sequence
  spacer sequence
caaccuaauuacugauccuu

SEQ ID NO: 8318 - RNA, 20 nt, Artificial Sequence
  spacer sequence
guaauuagguugggauaaca

SEQ ID NO: 8319 - RNA, 20 nt, Artificial Sequence
  spacer sequence
uuuaguacugcaauacugca

SEQ ID NO: 8320 - RNA, 20 nt, Artificial Sequence
  spacer sequence
ccacauuccuuuaucaaaau

SEQ ID NO: 8321 - RNA, 20 nt, Artificial Sequence
  spacer sequence
uuuaucaaaaugauaaaacu

SEQ ID NO: 8322 - RNA, 20 nt, Artificial Sequence
  spacer sequence
aaaugauaaaacugguuagu

SEQ ID NO: 8323 - RNA, 20 nt, Artificial Sequence
  spacer sequence
uuuugauaaaggaauguggu

SEQ ID NO: 8324 - RNA, 20 nt, Artificial Sequence
  spacer sequence
uagaugaacccuucuuaacu

SEQ ID NO: 8325 - RNA, 20 nt, Artificial Sequence
  spacer sequence
aagacuaaccaguuuuauca

SEQ ID NO: 8326 - RNA, 20 nt, Artificial Sequence
  spacer sequence
ucuaagacuaaccaguuuua

SEQ ID NO: 8327 - RNA, 20 nt, Artificial Sequence
  spacer sequence
uaacuugcauacacauuuaa

SEQ ID NO: 8328 - RNA, 20 nt, Artificial Sequence
  spacer sequence
uuccucuauaaggucaaaau

SEQ ID NO: 8329 - RNA, 20 nt, Artificial Sequence
  spacer sequence
ucuauaaggucaaaauuccu

SEQ ID NO: 8330 - RNA, 20 nt, Artificial Sequence
  spacer sequence
auaaggucaaaauuccugug

SEQ ID NO: 8331 - RNA, 20 nt, Artificial Sequence
  spacer sequence
aaauuccugugauauucuuu

SEQ ID NO: 8332 - RNA, 20 nt, Artificial Sequence
  spacer sequence
ugugauauucuuuucaagac

SEQ ID NO: 8333 - RNA, 20 nt, Artificial Sequence
  spacer sequence
caggaauuuugaccuuauag

SEQ ID NO: 8334 - RNA, 20 nt, Artificial Sequence
  spacer sequence
uuucaagacugcugacugaa

SEQ ID NO: 8335 - RNA, 20 nt, Artificial Sequence
  spacer sequence
agacugcugacugaaggcac

SEQ ID NO: 8336 - RNA, 20 nt, Artificial Sequence
  spacer sequence
ugaaaagaauaucacaggaa

SEQ ID NO: 8337 - RNA, 20 nt, Artificial Sequence
  spacer sequence
gcagucuugaaaagaauauc

SEQ ID NO: 8338 - RNA, 20 nt, Artificial Sequence
  spacer sequence
gucagcagucuugaaaagaa

SEQ ID NO: 8339 - RNA, 20 nt, Artificial Sequence
  spacer sequence
augugccuucagucagcagu

SEQ ID NO: 8340 - RNA, 20 nt, Artificial Sequence
  spacer sequence
uucucaugacugaacuaaca

SEQ ID NO: 8341 - RNA, 20 nt, Artificial Sequence
  spacer sequence
caugacugaacuaacauauu

SEQ ID NO: 8342 - RNA, 20 nt, Artificial Sequence
  spacer sequence
ugacugaacuaacauauugc

SEQ ID NO: 8343 - RNA, 20 nt, Artificial Sequence
  spacer sequence
ugagaaagaaagccuuccau

SEQ ID NO: 8344 - RNA, 20 nt, Artificial Sequence
  spacer sequence
gucaugagaaagaaagccuu

SEQ ID NO: 8345 - RNA, 20 nt, Artificial Sequence
  spacer sequence
aagugcuuauuuuaacaaaa

SEQ ID NO: 8346 - RNA, 20 nt, Artificial Sequence
  spacer sequence
cuuuucuuaugucaaauucu

SEQ ID NO: 8347 - RNA, 20 nt, Artificial Sequence
  spacer sequence
uaugucaaauucuaaacccu

SEQ ID NO: 8348 - RNA, 20 nt, Artificial Sequence
  spacer sequence
aauucuaaacccuucuggau

SEQ ID NO: 8349 - RNA, 20 nt, Artificial Sequence
  spacer sequence
aaacccuucuggauuuagaa

SEQ ID NO: 8350 - RNA, 20 nt, Artificial Sequence
  spacer sequence
ggauuuagaauagccuucaa

SEQ ID NO: 8351 - RNA, 20 nt, Artificial Sequence
  spacer sequence
agaaggguuuagaauuugac

SEQ ID NO: 8352 - RNA, 20 nt, Artificial Sequence
  spacer sequence
aaauccagaaggguuuagaa

SEQ ID NO: 8353 - RNA, 20 nt, Artificial Sequence
  spacer sequence
auuuuaaaauucuguuuuag

SEQ ID NO: 8354 - RNA, 20 nt, Artificial Sequence
  spacer sequence
guuuuagaacgaagauaauc

SEQ ID NO: 8355 - RNA, 20 nt, Artificial Sequence
  spacer sequence
aaaacagaauuuuaaaauug

SEQ ID NO: 8356 - RNA, 20 nt, Artificial Sequence
  spacer sequence
uucuaaaacagaauuuuaaa

SEQ ID NO: 8357 - RNA, 20 nt, Artificial Sequence
  spacer sequence
ucguucuaaaacagaauuuu

SEQ ID NO: 8358 - RNA, 20 nt, Artificial Sequence
  spacer sequence
ucagaaguaaaauaugaaca

SEQ ID NO: 8359 - RNA, 20 nt, Artificial Sequence
  spacer sequence
gaaguaaaauaugaacaguc

SEQ ID NO: 8360 - RNA, 20 nt, Artificial Sequence
  spacer sequence
gaugauuaucuucguucuaa

SEQ ID NO: 8361 - RNA, 20 nt, Artificial Sequence
  spacer sequence
uauuuuacuucugaugauua

SEQ ID NO: 8362 - RNA, 20 nt, Artificial Sequence
  spacer sequence
ugcauugaaaaccacccgcu

SEQ ID NO: 8363 - RNA, 20 nt, Artificial Sequence
  spacer sequence
augcaggacuguucauauuu

SEQ ID NO: 8364 - RNA, 20 nt, Artificial Sequence
  spacer sequence
uguaacaaauguuccccucu

SEQ ID NO: 8365 - RNA, 20 nt, Artificial Sequence
  spacer sequence
ccucucauggguccaucuag

SEQ ID NO: 8366 - RNA, 20 nt, Artificial Sequence
  spacer sequence
cauggguccaucuaguggga

SEQ ID NO: 8367 - RNA, 20 nt, Artificial Sequence
  spacer sequence
uggguccaucuagugggagg

SEQ ID NO: 8368 - RNA, 20 nt, Artificial Sequence
  spacer sequence
aucuagugggaggaagaugg

SEQ ID NO: 8369 - RNA, 20 nt, Artificial Sequence
  spacer sequence
agugggaggaagauggacau

SEQ ID NO: 8370 - RNA, 20 nt, Artificial Sequence
  spacer sequence
cacuagauggacccaugaga

SEQ ID NO: 8371 - RNA, 20 nt, Artificial Sequence
  spacer sequence
ucccacuagauggacccaug

SEQ ID NO: 8372 - RNA, 20 nt, Artificial Sequence
  spacer sequence
uccucccacuagauggaccc

SEQ ID NO: 8373 - RNA, 20 nt, Artificial Sequence
  spacer sequence
aucuuccucccacuagaugg

SEQ ID NO: 8374 - RNA, 20 nt, Artificial Sequence
  spacer sequence
ggugaugauaaacgcuacga

SEQ ID NO: 8375 - RNA, 20 nt, Artificial Sequence
  spacer sequence
ccugacauacuguuugcaug

SEQ ID NO: 8376 - RNA, 20 nt, Artificial Sequence
  spacer sequence
ucaccugacauacuguuugc

SEQ ID NO: 8377 - RNA, 20 nt, Artificial Sequence
  spacer sequence
uagcguuuaucaucaccuga

SEQ ID NO: 8378 - RNA, 20 nt, Artificial Sequence
  spacer sequence
gucguagcguuuaucaucac

SEQ ID NO: 8379 - RNA, 20 nt, Artificial Sequence
  spacer sequence
gaauuuaauuacuuuucuag

SEQ ID NO: 8380 - RNA, 20 nt, Artificial Sequence
  spacer sequence
gaaucagucguagcguuuau

SEQ ID NO: 8381 - RNA, 20 nt, Artificial Sequence
  spacer sequence
agccaugccuagcuuacuau

SEQ ID NO: 8382 - RNA, 20 nt, Artificial Sequence
  spacer sequence
aagcucaccgacuucucauc

SEQ ID NO: 8383 - RNA, 20 nt, Artificial Sequence
  spacer sequence
ccgacuucucaucuguguuu

SEQ ID NO: 8384 - RNA, 20 nt, Artificial Sequence
  spacer sequence
gugagcuuggaaaaacauag

SEQ ID NO: 8385 - RNA, 20 nt, Artificial Sequence
  spacer sequence
caucuguguuugguugcaca

SEQ ID NO: 8386 - RNA, 20 nt, Artificial Sequence
  spacer sequence
ucuguguuugguugcacaug

SEQ ID NO: 8387 - RNA, 20 nt, Artificial Sequence
  spacer sequence
guguuugguugcacauguug

SEQ ID NO: 8388 - RNA, 20 nt, Artificial Sequence
  spacer sequence
aacaugugcaaccaaacaca

SEQ ID NO: 8389 - RNA, 20 nt, Artificial Sequence
  spacer sequence
gcauccaacaugugcaacca

SEQ ID NO: 8390 - RNA, 20 nt, Artificial Sequence
  spacer sequence
guagugauaagaaauaacag

SEQ ID NO: 8391 - RNA, 20 nt, Artificial Sequence
  spacer sequence
cuacugaacauacaauuuaa

SEQ ID NO: 8392 - RNA, 20 nt, Artificial Sequence
  spacer sequence
uaucacuacugaacauacaa

SEQ ID NO: 8393 - RNA, 20 nt, Artificial Sequence
  spacer sequence
ucaagaccuaaauguuaaau

SEQ ID NO: 8394 - RNA, 20 nt, Artificial Sequence
  spacer sequence
agaccuaaauguuaaaucac

SEQ ID NO: 8395 - RNA, 20 nt, Artificial Sequence
  spacer sequence
ugaagacccugccuguuauu

SEQ ID NO: 8396 - RNA, 20 nt, Artificial Sequence
  spacer sequence
caggcaggcuacuuacuacg

SEQ ID NO: 8397 - RNA, 20 nt, Artificial Sequence
  spacer sequence
caguugcuugaaagcagugg

SEQ ID NO: 8398 - RNA, 20 nt, Artificial Sequence
  spacer sequence
agcaacugugaagcguagua

SEQ ID NO: 8399 - RNA, 20 nt, Artificial Sequence
  spacer sequence
uggaguucaugagaucuuuu

SEQ ID NO: 8400 - RNA, 20 nt, Artificial Sequence
  spacer sequence
aggaguuuaauaaccacugc

SEQ ID NO: 8401 - RNA, 20 nt, Artificial Sequence
  spacer sequence
ugagaucuuuucacucauuc

SEQ ID NO: 8402 - RNA, 20 nt, Artificial Sequence
  spacer sequence
ugaacuccaggaguuuaaua

SEQ ID NO: 8403 - RNA, 20 nt, Artificial Sequence
  spacer sequence
caugaacuccaggaguuuaa

SEQ ID NO: 8404 - RNA, 20 nt, Artificial Sequence
  spacer sequence
uuucacucauucaauaaauu

SEQ ID NO: 8405 - RNA, 20 nt, Artificial Sequence
  spacer sequence
cucauucaauaaauuuauua

SEQ ID NO: 8406 - RNA, 20 nt, Artificial Sequence
  spacer sequence
uucaauaaauuuauuaaacc

SEQ ID NO: 8407 - RNA, 20 nt, Artificial Sequence
  spacer sequence
auaaauuuauuaaacccagu

SEQ ID NO: 8408 - RNA, 20 nt, Artificial Sequence
  spacer sequence
gguagucuaacauccaugga

SEQ ID NO: 8409 - RNA, 20 nt, Artificial Sequence
  spacer sequence
aacauccauggaccuuagau

SEQ ID NO: 8410 - RNA, 20 nt, Artificial Sequence
  spacer sequence
auggaccuuagauuaggauu

SEQ ID NO: 8411 - RNA, 20 nt, Artificial Sequence
  spacer sequence
auggauguuagacuaccuga

SEQ ID NO: 8412 - RNA, 20 nt, Artificial Sequence
  spacer sequence
aagguccauggauguuagac

SEQ ID NO: 8413 - RNA, 20 nt, Artificial Sequence
  spacer sequence
uaaucuaagguccauggaug

SEQ ID NO: 8414 - RNA, 20 nt, Artificial Sequence
  spacer sequence
uaaucaaggguguguaugug

SEQ ID NO: 8415 - RNA, 20 nt, Artificial Sequence
  spacer sequence
aggguguguaugugggaugu

SEQ ID NO: 8416 - RNA, 20 nt, Artificial Sequence
  spacer sequence
cacauacacacccuugauua

SEQ ID NO: 8417 - RNA, 20 nt, Artificial Sequence
  spacer sequence
caucccacauacacacccuu

SEQ ID NO: 8418 - RNA, 20 nt, Artificial Sequence
  spacer sequence
ucacaucccacauacacacc

SEQ ID NO: 8419 - RNA, 20 nt, Artificial Sequence
  spacer sequence
agauucugugauucuugugc

SEQ ID NO: 8420 - RNA, 20 nt, Artificial Sequence
  spacer sequence
ggauagcaaccccuucuuca

SEQ ID NO: 8421 - RNA, 20 nt, Artificial Sequence
  spacer sequence
gugauucuugugcaaucaug

SEQ ID NO: 8422 - RNA, 20 nt, Artificial Sequence
  spacer sequence
cagaaucuggauagcaaccc

SEQ ID NO: 8423 - RNA, 20 nt, Artificial Sequence
  spacer sequence
ugugcaaucauguuaauaug

SEQ ID NO: 8424 - RNA, 20 nt, Artificial Sequence
  spacer sequence
uguuaauaugaaaaaaaaaa

SEQ ID NO: 8425 - RNA, 20 nt, Artificial Sequence
  spacer sequence
uauuaacaugauugcacaag

SEQ ID NO: 8426 - RNA, 20 nt, Artificial Sequence
  spacer sequence
uuuuuguuaugcuuuuuuuu

SEQ ID NO: 8427 - RNA, 20 nt, Artificial Sequence
  spacer sequence
uugcaucuuuuuuguuaugc

SEQ ID NO: 8428 - RNA, 20 nt, Artificial Sequence
  spacer sequence
cugguuccuaguccaauguu

SEQ ID NO: 8429 - RNA, 20 nt, Artificial Sequence
  spacer sequence
uaguccaauguuccuucuau

SEQ ID NO: 8430 - RNA, 20 nt, Artificial Sequence
  spacer sequence
aauguuccuucuaugauaug

SEQ ID NO: 8431 - RNA, 20 nt, Artificial Sequence
  spacer sequence
uucuaugauaugacuuccau

SEQ ID NO: 8432 - RNA, 20 nt, Artificial Sequence
  spacer sequence
augauaugacuuccauugga

SEQ ID NO: 8433 - RNA, 20 nt, Artificial Sequence
  spacer sequence
uagaaggaacauuggacuag

SEQ ID NO: 8434 - RNA, 20 nt, Artificial Sequence
  spacer sequence
uaucauagaaggaacauugg

SEQ ID NO: 8435 - RNA, 20 nt, Artificial Sequence
  spacer sequence
auuggaagguagaccucuua

SEQ ID NO: 8436 - RNA, 20 nt, Artificial Sequence
  spacer sequence
aauggaagucauaucauaga

SEQ ID NO: 8437 - RNA, 20 nt, Artificial Sequence
  spacer sequence
accuuccaauggaagucaua

SEQ ID NO: 8438 - RNA, 20 nt, Artificial Sequence
  spacer sequence
uaagcaacuuccucauuaaa

SEQ ID NO: 8439 - RNA, 20 nt, Artificial Sequence
  spacer sequence
ucauuaaacaaaucauuuuc

SEQ ID NO: 8440 - RNA, 20 nt, Artificial Sequence
  spacer sequence
uuaaacaaaucauuuuccau

SEQ ID NO: 8441 - RNA, 20 nt, Artificial Sequence
  spacer sequence
uuuuccaucauuaugguaac

SEQ ID NO: 8442 - RNA, 20 nt, Artificial Sequence
  spacer sequence
aucauuaugguaacuacacu

SEQ ID NO: 8443 - RNA, 20 nt, Artificial Sequence
  spacer sequence
uuaugguaacuacacuccug

SEQ ID NO: 8444 - RNA, 20 nt, Artificial Sequence
  spacer sequence
uguaucacuugugauaaauu

SEQ ID NO: 8445 - RNA, 20 nt, Artificial Sequence
  spacer sequence
cuugugauaaauuuuaaucc

SEQ ID NO: 8446 - RNA, 20 nt, Artificial Sequence
  spacer sequence
caagugauacaggaguguag

SEQ ID NO: 8447 - RNA, 20 nt, Artificial Sequence
  spacer sequence
caaauccucuuuuaccauua

SEQ ID NO: 8448 - RNA, 20 nt, Artificial Sequence
  spacer sequence
ucuuuuaccauuacccaauc

SEQ ID NO: 8449 - RNA, 20 nt, Artificial Sequence
  spacer sequence
uuuaccauuacccaaucugu

SEQ ID NO: 8450 - RNA, 20 nt, Artificial Sequence
  spacer sequence
guguacuaagggaaauaaac

SEQ ID NO: 8451 - RNA, 20 nt, Artificial Sequence
  spacer sequence
cuuaguacacagauugggua

SEQ ID NO: 8452 - RNA, 20 nt, Artificial Sequence
  spacer sequence
aggcuauuaucagccuaagc

SEQ ID NO: 8453 - RNA, 20 nt, Artificial Sequence
  spacer sequence
gccuaagcuuagucuagggg

SEQ ID NO: 8454 - RNA, 20 nt, Artificial Sequence
  spacer sequence
aggggagggcagaauacagu

SEQ ID NO: 8455 - RNA, 20 nt, Artificial Sequence
  spacer sequence
ccuagacuaagcuuaggcug

SEQ ID NO: 8456 - RNA, 20 nt, Artificial Sequence
  spacer sequence
gcccuccccuagacuaagcu

SEQ ID NO: 8457 - RNA, 20 nt, Artificial Sequence
  spacer sequence
aacaguacugaauagcauag

SEQ ID NO: 8458 - RNA, 20 nt, Artificial Sequence
  spacer sequence
guacuguuggaauuuuuuau

SEQ ID NO: 8459 - RNA, 20 nt, Artificial Sequence
  spacer sequence
ccuaugcuauucaguacugu

SEQ ID NO: 8460 - RNA, 20 nt, Artificial Sequence
  spacer sequence
uccauuacaaaccaaugucu

SEQ ID NO: 8461 - RNA, 20 nt, Artificial Sequence
  spacer sequence
auuacaaaccaaugucucac

SEQ ID NO: 8462 - RNA, 20 nt, Artificial Sequence
  spacer sequence
cacaguccuacaucucagag

SEQ ID NO: 8463 - RNA, 20 nt, Artificial Sequence
  spacer sequence
caguccuacaucucagaggu

SEQ ID NO: 8464 - RNA, 20 nt, Artificial Sequence
  spacer sequence
uacaucucagagguaaucaa

SEQ ID NO: 8465 - RNA, 20 nt, Artificial Sequence
  spacer sequence
cagagguaaucaauagguuc

SEQ ID NO: 8466 - RNA, 20 nt, Artificial Sequence
  spacer sequence
gagguaaucaauagguucuu

SEQ ID NO: 8467 - RNA, 20 nt, Artificial Sequence
  spacer sequence
gagauguaggacugugagac

SEQ ID NO: 8468 - RNA, 20 nt, Artificial Sequence
  spacer sequence
auagguucuuuccuaaaaca

SEQ ID NO: 8469 - RNA, 20 nt, Artificial Sequence
  spacer sequence
uuccuaaaacaacucagauu

SEQ ID NO: 8470 - RNA, 20 nt, Artificial Sequence
  spacer sequence
uaaaacaacucagauuauga

SEQ ID NO: 8471 - RNA, 20 nt, Artificial Sequence
  spacer sequence
gauuaugaaagcaaacaggc

SEQ ID NO: 8472 - RNA, 20 nt, Artificial Sequence
  spacer sequence
gaguuguuuuaggaaagaac

SEQ ID NO: 8473 - RNA, 20 nt, Artificial Sequence
  spacer sequence
uaaucugaguuguuuuagga

SEQ ID NO: 8474 - RNA, 20 nt, Artificial Sequence
  spacer sequence
aagguauaugcauaugccug

SEQ ID NO: 8475 - RNA, 20 nt, Artificial Sequence
  spacer sequence
caggacuagaacacuguaau

SEQ ID NO: 8476 - RNA, 20 nt, Artificial Sequence
  spacer sequence
ugugagcccauaguauuuuu

SEQ ID NO: 8477 - RNA, 20 nt, Artificial Sequence
  spacer sequence
aguccugugagcccauagua

SEQ ID NO: 8478 - RNA, 20 nt, Artificial Sequence
  spacer sequence
caagauauuaacuuccaguu

SEQ ID NO: 8479 - RNA, 20 nt, Artificial Sequence
  spacer sequence
agauauuaacuuccaguuag

SEQ ID NO: 8480 - RNA, 20 nt, Artificial Sequence
  spacer sequence
ugagaguauuacaguguucu

SEQ ID NO: 8481 - RNA, 20 nt, Artificial Sequence
  spacer sequence
aguuaggggauucaaguguu

SEQ ID NO: 8482 - RNA, 20 nt, Artificial Sequence
  spacer sequence
ccuaacuggaaguuaauauc

SEQ ID NO: 8483 - RNA, 20 nt, Artificial Sequence
  spacer sequence
aguguuaauuauauuuggca

SEQ ID NO: 8484 - RNA, 20 nt, Artificial Sequence
  spacer sequence
aauacaacaauuuguuaauu

SEQ ID NO: 8485 - RNA, 20 nt, Artificial Sequence
  spacer sequence
uuuaaauuaacaaauuguug

SEQ ID NO: 8486 - RNA, 20 nt, Artificial Sequence
  spacer sequence
acuguaacaagcaugugaug

SEQ ID NO: 8487 - RNA, 20 nt, Artificial Sequence
  spacer sequence
caugcuuguuacaguagacc

SEQ ID NO: 8488 - RNA, 20 nt, Artificial Sequence
  spacer sequence
uaacuuaagcaggcaagagu

SEQ ID NO: 8489 - RNA, 20 nt, Artificial Sequence
  spacer sequence
ugccugcuuaaguuaugaau

SEQ ID NO: 8490 - RNA, 20 nt, Artificial Sequence
  spacer sequence
uuaagcaggcuuacucuugc

SEQ ID NO: 8491 - RNA, 20 nt, Artificial Sequence
  spacer sequence
uuuacaucuuuaagcaggcu

SEQ ID NO: 8492 - RNA, 20 nt, Artificial Sequence
  spacer sequence
aagucacaucgcccuugauc

SEQ ID NO: 8493 - RNA, 20 nt, Artificial Sequence
  spacer sequence
caucgcccuugaucacagua

SEQ ID NO: 8494 - RNA, 20 nt, Artificial Sequence
  spacer sequence
cccuugaucacaguauugaa

SEQ ID NO: 8495 - RNA, 20 nt, Artificial Sequence
  spacer sequence
agggcgaugugacuuagauc

SEQ ID NO: 8496 - RNA, 20 nt, Artificial Sequence
  spacer sequence
caguauugaaguugugggua

SEQ ID NO: 8497 - RNA, 20 nt, Artificial Sequence
  spacer sequence
auacugugaucaagggcgau

SEQ ID NO: 8498 - RNA, 20 nt, Artificial Sequence
  spacer sequence
guuguacuuuuuacccacaa

SEQ ID NO: 8499 - RNA, 20 nt, Artificial Sequence
  spacer sequence
agccaaguaaacugagagug

SEQ ID NO: 8500 - RNA, 20 nt, Artificial Sequence
  spacer sequence
guuuacuuggcuggaguuua

SEQ ID NO: 8501 - RNA, 20 nt, Artificial Sequence
  spacer sequence
caguuuacuuggcuggaguu

SEQ ID NO: 8502 - RNA, 20 nt, Artificial Sequence
  spacer sequence
cucucaguuuacuuggcugg

SEQ ID NO: 8503 - RNA, 20 nt, Artificial Sequence
  spacer sequence
cacucacucucaguuuacuu

SEQ ID NO: 8504 - RNA, 20 nt, Artificial Sequence
  spacer sequence
ggcugcgcaacuguuacuua

SEQ ID NO: 8505 - RNA, 20 nt, Artificial Sequence
  spacer sequence
aaguaacaguugcgcagccu

SEQ ID NO: 8506 - RNA, 20 nt, Artificial Sequence
  spacer sequence
aauaaaauggcuuuguuuuc

SEQ ID NO: 8507 - RNA, 20 nt, Artificial Sequence
  spacer sequence
aagaugauuucuuugcuagc

SEQ ID NO: 8508 - RNA, 20 nt, Artificial Sequence
  spacer sequence
uugauacauuccaauaaaau

SEQ ID NO: 8509 - RNA, 20 nt, Artificial Sequence
  spacer sequence
ucuuugauacauuccaauaa

SEQ ID NO: 8510 - RNA, 20 nt, Artificial Sequence
  spacer sequence
uugcuagcccacaaagaacg

SEQ ID NO: 8511 - RNA, 20 nt, Artificial Sequence
  spacer sequence
uugugggcuagcaaagaaau

SEQ ID NO: 8512 - RNA, 20 nt, Artificial Sequence
  spacer sequence
agggguuucagauagauaau

SEQ ID NO: 8513 - RNA, 20 nt, Artificial Sequence
  spacer sequence
gauagauaauaauuggucca

SEQ ID NO: 8514 - RNA, 20 nt, Artificial Sequence
  spacer sequence
gaaaccccuggacuugggua

SEQ ID NO: 8515 - RNA, 20 nt, Artificial Sequence
  spacer sequence
aucugaaaccccuggacuug

SEQ ID NO: 8516 - RNA, 20 nt, Artificial Sequence
  spacer sequence
agacagagaaaaaccuaugc

SEQ ID NO: 8517 - RNA, 20 nt, Artificial Sequence
  spacer sequence
ggaccaauuauuaucuaucu

SEQ ID NO: 8518 - RNA, 20 nt, Artificial Sequence
  spacer sequence
gucuggaccaauuauuaucu

SEQ ID NO: 8519 - RNA, 20 nt, Artificial Sequence
  spacer sequence
cugucuggaccaauuauuau

SEQ ID NO: 8520 - RNA, 20 nt, Artificial Sequence
  spacer sequence
uuaacggcauagguuuuucu

SEQ ID NO: 8521 - RNA, 20 nt, Artificial Sequence
  spacer sequence
ccuaaaagcugggaagagac

SEQ ID NO: 8522 - RNA, 20 nt, Artificial Sequence
  spacer sequence
uaaaagcugggaagagacua

SEQ ID NO: 8523 - RNA, 20 nt, Artificial Sequence
  spacer sequence
cagcuuuuaggagauacuuc

SEQ ID NO: 8524 - RNA, 20 nt, Artificial Sequence
  spacer sequence
ucccagcuuuuaggagauac

SEQ ID NO: 8525 - RNA, 20 nt, Artificial Sequence
  spacer sequence
cuucccagcuuuuaggagau

SEQ ID NO: 8526 - RNA, 20 nt, Artificial Sequence
  spacer sequence
cuuaaccuuagucucuuccc

SEQ ID NO: 8527 - RNA, 20 nt, Artificial Sequence
  spacer sequence
uaauucacuuaaccuuaguc

SEQ ID NO: 8528 - RNA, 20 nt, Artificial Sequence
  spacer sequence
guaccaauuccuuugcacag

SEQ ID NO: 8529 - RNA, 20 nt, Artificial Sequence
  spacer sequence
uuugcacagagauuacuuuu

SEQ ID NO: 8530 - RNA, 20 nt, Artificial Sequence
  spacer sequence
gugcaaaggaauugguacag

SEQ ID NO: 8531 - RNA, 20 nt, Artificial Sequence
  spacer sequence
cugugcaaaggaauugguac

SEQ ID NO: 8532 - RNA, 20 nt, Artificial Sequence
  spacer sequence
uuuuucuauaccaaauaagg

SEQ ID NO: 8533 - RNA, 20 nt, Artificial Sequence
  spacer sequence
auaccaaauaaggaugugaa

SEQ ID NO: 8534 - RNA, 20 nt, Artificial Sequence
  spacer sequence
uuauuugguauagaaaaaug

SEQ ID NO: 8535 - RNA, 20 nt, Artificial Sequence
  spacer sequence
cauccuuauuugguauagaa

SEQ ID NO: 8536 - RNA, 20 nt, Artificial Sequence
  spacer sequence
ucacauccuuauuugguaua

SEQ ID NO: 8537 - RNA, 20 nt, Artificial Sequence
  spacer sequence
aaacuuuuauucaagacaga

SEQ ID NO: 8538 - RNA, 20 nt, Artificial Sequence
  spacer sequence
agacagacaaacaugauuuu

SEQ ID NO: 8539 - RNA, 20 nt, Artificial Sequence
  spacer sequence
ugaauaaaaguuuggaucuu

SEQ ID NO: 8540 - RNA, 20 nt, Artificial Sequence
  spacer sequence
gucuugaauaaaaguuugga

SEQ ID NO: 8541 - RNA, 20 nt, Artificial Sequence
  spacer sequence
uguuugucugucuugaauaa

SEQ ID NO: 8542 - RNA, 20 nt, Artificial Sequence
  spacer sequence
uugagauucucucuugguaa

SEQ ID NO: 8543 - RNA, 20 nt, Artificial Sequence
  spacer sequence
aagacaaaaucauguuuguc

SEQ ID NO: 8544 - RNA, 20 nt, Artificial Sequence
  spacer sequence
caaagacaaaaucauguuug

SEQ ID NO: 8545 - RNA, 20 nt, Artificial Sequence
  spacer sequence
cucuugguaaagaucaagua

SEQ ID NO: 8546 - RNA, 20 nt, Artificial Sequence
  spacer sequence
cuugguaaagaucaaguaca

SEQ ID NO: 8547 - RNA, 20 nt, Artificial Sequence
  spacer sequence
ugguaaagaucaaguacaca

SEQ ID NO: 8548 - RNA, 20 nt, Artificial Sequence
  spacer sequence
uuaccaagagagaaucucaa

SEQ ID NO: 8549 - RNA, 20 nt, Artificial Sequence
  spacer sequence
aguacacauauuugacuuua

SEQ ID NO: 8550 - RNA, 20 nt, Artificial Sequence
  spacer sequence
aauauguguacuugaucuuu

SEQ ID NO: 8551 - RNA, 20 nt, Artificial Sequence
  spacer sequence
uaaagucaaauauguguacu

SEQ ID NO: 8552 - RNA, 20 nt, Artificial Sequence
  spacer sequence
ucuuaaagucaaauaugugu

SEQ ID NO: 8553 - RNA, 20 nt, Artificial Sequence
  spacer sequence
uccucuuaaagucaaauaug

SEQ ID NO: 8554 - RNA, 20 nt, Artificial Sequence
  spacer sequence
uccucaaaaacaaacaaaca

SEQ ID NO: 8555 - RNA, 20 nt, Artificial Sequence
  spacer sequence
ucaaaaacaaacaaacaaac

SEQ ID NO: 8556 - RNA, 20 nt, Artificial Sequence
  spacer sequence
aaaacaaacaaacaaacaaa

SEQ ID NO: 8557 - RNA, 20 nt, Artificial Sequence
  spacer sequence
uggaaauaauuuuaccaaaa

SEQ ID NO: 8558 - RNA, 20 nt, Artificial Sequence
  spacer sequence
aagacuggcuuuuuugguug

SEQ ID NO: 8559 - RNA, 20 nt, Artificial Sequence
  spacer sequence
aacuuggggauggguggggg

SEQ ID NO: 8560 - RNA, 20 nt, Artificial Sequence
  spacer sequence
ccaaguuagauuuuuuuaaa

SEQ ID NO: 8561 - RNA, 20 nt, Artificial Sequence
  spacer sequence
uugccccaccccccccccac

SEQ ID NO: 8562 - RNA, 20 nt, Artificial Sequence
  spacer sequence
uuaguuuuccuugccccacc

SEQ ID NO: 8563 - RNA, 20 nt, Artificial Sequence
  spacer sequence
ugguaaguuauuuuuuuuua

SEQ ID NO: 8564 - RNA, 20 nt, Artificial Sequence
  spacer sequence
cuucuugguaaguuauuuuu

SEQ ID NO: 8565 - RNA, 20 nt, Artificial Sequence
  spacer sequence
uguaacccagccuguuucac

SEQ ID NO: 8566 - RNA, 20 nt, Artificial Sequence
  spacer sequence
gcccaccccuccuguaaccc

SEQ ID NO: 8567 - RNA, 20 nt, Artificial Sequence
  spacer sequence
ugggugcagcagguggcacg

SEQ ID NO: 8568 - RNA, 20 nt, Artificial Sequence
  spacer sequence
gccgugccaccugcugcacc

SEQ ID NO: 8569 - RNA, 20 nt, Artificial Sequence
  spacer sequence
cgcugucaccagacucggcg

SEQ ID NO: 8570 - RNA, 20 nt, Artificial Sequence
  spacer sequence
ccagacucggcguuuccucu

SEQ ID NO: 8571 - RNA, 20 nt, Artificial Sequence
  spacer sequence
ggugacagcgugaaaaugua

SEQ ID NO: 8572 - RNA, 20 nt, Artificial Sequence
  spacer sequence
gcguuuccucuagccccaga

SEQ ID NO: 8573 - RNA, 20 nt, Artificial Sequence
  spacer sequence
ucuagccccagacaccacug

SEQ ID NO: 8574 - RNA, 20 nt, Artificial Sequence
  spacer sequence
agccccagacaccacuguug

SEQ ID NO: 8575 - RNA, 20 nt, Artificial Sequence
  spacer sequence
ggggcuagaggaaacgccga

SEQ ID NO: 8576 - RNA, 20 nt, Artificial Sequence
  spacer sequence
aacaguggugucuggggcua

SEQ ID NO: 8577 - RNA, 20 nt, Artificial Sequence
  spacer sequence
cauuccaacaguggugucug

SEQ ID NO: 8578 - RNA, 20 nt, Artificial Sequence
  spacer sequence
aauagauaagucuuuuguag

SEQ ID NO: 8579 - RNA, 20 nt, Artificial Sequence
  spacer sequence
auuggaaaucccauuccaac

SEQ ID NO: 8580 - RNA, 20 nt, Artificial Sequence
  spacer sequence
uuuguagugucuucauuuau

SEQ ID NO: 8581 - RNA, 20 nt, Artificial Sequence
  spacer sequence
ucauuuauaccagcgauagu

SEQ ID NO: 8582 - RNA, 20 nt, Artificial Sequence
  spacer sequence
uuuauaccagcgauaguagc

SEQ ID NO: 8583 - RNA, 20 nt, Artificial Sequence
  spacer sequence
cugguauaaaugaagacacu

SEQ ID NO: 8584 - RNA, 20 nt, Artificial Sequence
  spacer sequence
uuagcuacuaucgcugguau

SEQ ID NO: 8585 - RNA, 20 nt, Artificial Sequence
  spacer sequence
acaugugaagcugaauaauu

SEQ ID NO: 8586 - RNA, 20 nt, Artificial Sequence
  spacer sequence
cauguugauauaauuauauu

SEQ ID NO: 8587 - RNA, 20 nt, Artificial Sequence
  spacer sequence
gcuucacauguugauauaau

SEQ ID NO: 8588 - RNA, 20 nt, Artificial Sequence
  spacer sequence
cccggucaacauucuuaugc

SEQ ID NO: 8589 - RNA, 20 nt, Artificial Sequence
  spacer sequence
cggucaacauucuuaugcca

SEQ ID NO: 8590 - RNA, 20 nt, Artificial Sequence
  spacer sequence
acauucuuaugccauacuau

SEQ ID NO: 8591 - RNA, 20 nt, Artificial Sequence
  spacer sequence
uaugccauacuauagauccu

SEQ ID NO: 8592 - RNA, 20 nt, Artificial Sequence
  spacer sequence
auaguauggcauaagaaugu

SEQ ID NO: 8593 - RNA, 20 nt, Artificial Sequence
  spacer sequence
uauuaccgcuucacucuccc

SEQ ID NO: 8594 - RNA, 20 nt, Artificial Sequence
  spacer sequence
cucucccuccuacacccagc

SEQ ID NO: 8595 - RNA, 20 nt, Artificial Sequence
  spacer sequence
cccuccuacacccagcucca

SEQ ID NO: 8596 - RNA, 20 nt, Artificial Sequence
  spacer sequence
cuccuacacccagcuccaag

SEQ ID NO: 8597 - RNA, 20 nt, Artificial Sequence
  spacer sequence
uacacccagcuccaagagga

SEQ ID NO: 8598 - RNA, 20 nt, Artificial Sequence
  spacer sequence
aagaggauaagcaaacacaa

SEQ ID NO: 8599 - RNA, 20 nt, Artificial Sequence
  spacer sequence
uggagcuggguguaggaggg

SEQ ID NO: 8600 - RNA, 20 nt, Artificial Sequence
  spacer sequence
ucuuggagcuggguguagga

SEQ ID NO: 8601 - RNA, 20 nt, Artificial Sequence
  spacer sequence
uuguguuugcuuauccucuu

SEQ ID NO: 8602 - RNA, 20 nt, Artificial Sequence
  spacer sequence
caaacuguaagcauguuuuu

SEQ ID NO: 8603 - RNA, 20 nt, Artificial Sequence
  spacer sequence
accaauaagcaucccaaacu

SEQ ID NO: 8604 - RNA, 20 nt, Artificial Sequence
  spacer sequence
cacuccaccaauaagcaucc

SEQ ID NO: 8605 - RNA, 20 nt, Artificial Sequence
  spacer sequence
ucacacuccaccaauaagca

SEQ ID NO: 8606 - RNA, 20 nt, Artificial Sequence
  spacer sequence
uccucacacuccaccaauaa

SEQ ID NO: 8607 - RNA, 20 nt, Artificial Sequence
  spacer sequence
uccuccucacacuccaccaa

SEQ ID NO: 8608 - RNA, 20 nt, Artificial Sequence
  spacer sequence
auuccuccuccucacacucc

SEQ ID NO: 8609 - RNA, 20 nt, Artificial Sequence
  spacer sequence
accaguauccauuccuccuc

SEQ ID NO: 8610 - RNA, 20 nt, Artificial Sequence
  spacer sequence
uauaacuccaccaguaucca

SEQ ID NO: 8611 - RNA, 20 nt, Artificial Sequence
  spacer sequence
aggaggcagaaaaccuagaa

SEQ ID NO: 8612 - RNA, 20 nt, Artificial Sequence
  spacer sequence
uggacccccaccuccuauaa

SEQ ID NO: 8613 - RNA, 20 nt, Artificial Sequence
  spacer sequence
gccuccuggacccccaccuc

SEQ ID NO: 8614 - RNA, 20 nt, Artificial Sequence
  spacer sequence
agguuuucugccuccuggac

SEQ ID NO: 8615 - RNA, 20 nt, Artificial Sequence
  spacer sequence
uauucuagguuuucugccuc

SEQ ID NO: 8616 - RNA, 20 nt, Artificial Sequence
  spacer sequence
acuuaugcuguaucacucca

SEQ ID NO: 8617 - RNA, 20 nt, Artificial Sequence
  spacer sequence
cuccaucgcaggcucuaaag

SEQ ID NO: 8618 - RNA, 20 nt, Artificial Sequence
  spacer sequence
aucgcaggcucuaaaguaug

SEQ ID NO: 8619 - RNA, 20 nt, Artificial Sequence
  spacer sequence
caggcucuaaaguauguuca

SEQ ID NO: 8620 - RNA, 20 nt, Artificial Sequence
  spacer sequence
aaaguauguucacagacaau

SEQ ID NO: 8621 - RNA, 20 nt, Artificial Sequence
  spacer sequence
cagacaauuuaguguaccug

SEQ ID NO: 8622 - RNA, 20 nt, Artificial Sequence
  spacer sequence
gugaacauacuuuagagccu

SEQ ID NO: 8623 - RNA, 20 nt, Artificial Sequence
  spacer sequence
acccaaugcauuuaccacca

SEQ ID NO: 8624 - RNA, 20 nt, Artificial Sequence
  spacer sequence
ugggcgcaaaaaugguggag

SEQ ID NO: 8625 - RNA, 20 nt, Artificial Sequence
  spacer sequence
accauuuuugcgcccaggau

SEQ ID NO: 8626 - RNA, 20 nt, Artificial Sequence
  spacer sequence
uccaccauuuuugcgcccag

SEQ ID NO: 8627 - RNA, 20 nt, Artificial Sequence
  spacer sequence
uccuccaccauuuuugcgcc

SEQ ID NO: 8628 - RNA, 20 nt, Artificial Sequence
  spacer sequence
cccuccuccuccaccauuuu

SEQ ID NO: 8629 - RNA, 20 nt, Artificial Sequence
  spacer sequence
ucccccuccuccuccaccau

SEQ ID NO: 8630 - RNA, 20 nt, Artificial Sequence
  spacer sequence
uccucccccuccuccuccac

SEQ ID NO: 8631 - RNA, 20 nt, Artificial Sequence
  spacer sequence
ugguguuccuccucccccuc

SEQ ID NO: 8632 - RNA, 20 nt, Artificial Sequence
  spacer sequence
aggcuuugguccugguguuc

SEQ ID NO: 8633 - RNA, 20 nt, Artificial Sequence
  spacer sequence
cagaggaggcgugaaagcag

SEQ ID NO: 8634 - RNA, 20 nt, Artificial Sequence
  spacer sequence
gggaauaccgccuccaggcu

SEQ ID NO: 8635 - RNA, 20 nt, Artificial Sequence
  spacer sequence
ucugggaauaccgccuccag

SEQ ID NO: 8636 - RNA, 20 nt, Artificial Sequence
  spacer sequence
cgccuccucugggaauaccg

SEQ ID NO: 8637 - RNA, 20 nt, Artificial Sequence
  spacer sequence
agccgccugcuuucacgccu

SEQ ID NO: 8638 - RNA, 20 nt, Artificial Sequence
  spacer sequence
ccagccgccugcuuucacgc

SEQ ID NO: 8639 - RNA, 20 nt, Artificial Sequence
  spacer sequence
accuguaguuggugcucucc

SEQ ID NO: 8640 - RNA, 20 nt, Artificial Sequence
  spacer sequence
accggguccaccuguaguug

SEQ ID NO: 8641 - RNA, 20 nt, Artificial Sequence
  spacer sequence
caccacaucaaccgggucca

SEQ ID NO: 8642 - RNA, 20 nt, Artificial Sequence
  spacer sequence
aggucccaccacaucaaccg

SEQ ID NO: 8643 - RNA, 20 nt, Artificial Sequence
  spacer sequence
uucuaggucccaccacauca

SEQ ID NO: 8644 - RNA, 20 nt, Artificial Sequence
  spacer sequence
uucuuucuaggucccaccac

SEQ ID NO: 8645 - RNA, 20 nt, Artificial Sequence
  spacer sequence
uuuaucuuucuuucuagguc

SEQ ID NO: 8646 - RNA, 20 nt, Artificial Sequence
  spacer sequence
agacacccucccauccacac

SEQ ID NO: 8647 - RNA, 20 nt, Artificial Sequence
  spacer sequence
agauaggugguuuauucuuu

SEQ ID NO: 8648 - RNA, 20 nt, Artificial Sequence
  spacer sequence
cauccacacaguaagcacag

SEQ ID NO: 8649 - RNA, 20 nt, Artificial Sequence
  spacer sequence
acacaguaagcacagauaaa

SEQ ID NO: 8650 - RNA, 20 nt, Artificial Sequence
  spacer sequence
gugcuuacuguguggauggg

SEQ ID NO: 8651 - RNA, 20 nt, Artificial Sequence
  spacer sequence
uuuaucugugcuuacugugu

SEQ ID NO: 8652 - RNA, 20 nt, Artificial Sequence
  spacer sequence
acaguuugcucuuuuaucug

SEQ ID NO: 8653 - RNA, 20 nt, Artificial Sequence
  spacer sequence
auuuuuucaacaguuugcuc

SEQ ID NO: 8654 - RNA, 20 nt, Artificial Sequence
  spacer sequence
uaauuugugcuuauuagacc

SEQ ID NO: 8655 - RNA, 20 nt, Artificial Sequence
  spacer sequence
aauaagcacaaauuaagaaa

SEQ ID NO: 8656 - RNA, 20 nt, Artificial Sequence
  spacer sequence
auucauaccaacugauagaa

SEQ ID NO: 8657 - RNA, 20 nt, Artificial Sequence
  spacer sequence
uaccaacugauagaaaucaa

SEQ ID NO: 8658 - RNA, 20 nt, Artificial Sequence
  spacer sequence
guugguaugaauagaaguua

SEQ ID NO: 8659 - RNA, 20 nt, Artificial Sequence
  spacer sequence
aucaguugguaugaauagaa

SEQ ID NO: 8660 - RNA, 20 nt, Artificial Sequence
  spacer sequence
aagcugugggccgggugugg

SEQ ID NO: 8661 - RNA, 20 nt, Artificial Sequence
  spacer sequence
caccuguaaucccagcauuu

SEQ ID NO: 8662 - RNA, 20 nt, Artificial Sequence
  spacer sequence
cagcauuuugggaggccgag

SEQ ID NO: 8663 - RNA, 20 nt, Artificial Sequence
  spacer sequence
caaaaugcugggauuacagg

SEQ ID NO: 8664 - RNA, 20 nt, Artificial Sequence
  spacer sequence
gccucccaaaaugcugggau

SEQ ID NO: 8665 - RNA, 20 nt, Artificial Sequence
  spacer sequence
gccugccucggccucccaaa

SEQ ID NO: 8666 - RNA, 20 nt, Artificial Sequence
  spacer sequence
ccuaaggucaggaguucaag

SEQ ID NO: 8667 - RNA, 20 nt, Artificial Sequence
  spacer sequence
ggaguucaagaccagccugg

SEQ ID NO: 8668 - RNA, 20 nt, Artificial Sequence
  spacer sequence
ugaccuuaggugauccgccu

SEQ ID NO: 8669 - RNA, 20 nt, Artificial Sequence
  spacer sequence
agaccagccuggucaacaug

SEQ ID NO: 8670 - RNA, 20 nt, Artificial Sequence
  spacer sequence
ugaacuccugaccuuaggug

SEQ ID NO: 8671 - RNA, 20 nt, Artificial Sequence
  spacer sequence
acauggcgaaacccugucug

SEQ ID NO: 8672 - RNA, 20 nt, Artificial Sequence
  spacer sequence
ccauguugaccaggcugguc

SEQ ID NO: 8673 - RNA, 20 nt, Artificial Sequence
  spacer sequence
guacuaaaaauacaaaaauu

SEQ ID NO: 8674 - RNA, 20 nt, Artificial Sequence
  spacer sequence
cagcuacuccggaggcugag

SEQ ID NO: 8675 - RNA, 20 nt, Artificial Sequence
  spacer sequence
ggaggcugaggcaggagaau

SEQ ID NO: 8676 - RNA, 20 nt, Artificial Sequence
  spacer sequence
ggaguagcugggauuacagg

SEQ ID NO: 8677 - RNA, 20 nt, Artificial Sequence
  spacer sequence
gccuccggaguagcugggau

SEQ ID NO: 8678 - RNA, 20 nt, Artificial Sequence
  spacer sequence
ugccucagccuccggaguag

SEQ ID NO: 8679 - RNA, 20 nt, Artificial Sequence
  spacer sequence
ccugccucagccuccggagu

SEQ ID NO: 8680 - RNA, 20 nt, Artificial Sequence
  spacer sequence
agcaauucuccugccucagc

SEQ ID NO: 8681 - RNA, 20 nt, Artificial Sequence
  spacer sequence
ggagguggagguugcaguga

SEQ ID NO: 8682 - RNA, 20 nt, Artificial Sequence
  spacer sequence
cgaguucaagcaauucuccu

SEQ ID NO: 8683 - RNA, 20 nt, Artificial Sequence
  spacer sequence
accucccgaguucaagcaau

SEQ ID NO: 8684 - RNA, 20 nt, Artificial Sequence
  spacer sequence
cugcaaccuccaccucccga

SEQ ID NO: 8685 - RNA, 20 nt, Artificial Sequence
  spacer sequence
gcucacugcaaccuccaccu

SEQ ID NO: 8686 - RNA, 20 nt, Artificial Sequence
  spacer sequence
cggcucacugcaaccuccac

SEQ ID NO: 8687 - RNA, 20 nt, Artificial Sequence
  spacer sequence
agccugggcgacagagcaag

SEQ ID NO: 8688 - RNA, 20 nt, Artificial Sequence
  spacer sequence
cccaggcuggagugcagugg

SEQ ID NO: 8689 - RNA, 20 nt, Artificial Sequence
  spacer sequence
gucgcccaggcuggagugca

SEQ ID NO: 8690 - RNA, 20 nt, Artificial Sequence
  spacer sequence
ugcucugucgcccaggcugg

SEQ ID NO: 8691 - RNA, 20 nt, Artificial Sequence
  spacer sequence
ucaaaaaaaaaaaaagaaaa

SEQ ID NO: 8692 - RNA, 20 nt, Artificial Sequence
  spacer sequence
aaaaaaaaaaaagaaaaaaa

SEQ ID NO: 8693 - RNA, 20 nt, Artificial Sequence
  spacer sequence
uuuuuuuuuuuugaagacca

SEQ ID NO: 8694 - RNA, 20 nt, Artificial Sequence
  spacer sequence
uuuuuuuuuuuuuucuuuuu

SEQ ID NO: 8695 - RNA, 20 nt, Artificial Sequence
  spacer sequence
uuccuuuuuuuuuuuuuucu

SEQ ID NO: 8696 - RNA, 20 nt, Artificial Sequence
  spacer sequence
uucuuuccuuuuuuuuuuuu

SEQ ID NO: 8697 - RNA, 20 nt, Artificial Sequence
  spacer sequence
uucuuucuuuccuuuuuuuu

SEQ ID NO: 8698 - RNA, 20 nt, Artificial Sequence
  spacer sequence
aaguugcgcucuucacuuua

SEQ ID NO: 8699 - RNA, 20 nt, Artificial Sequence
  spacer sequence
ucacuuuaugacagcaauuu

SEQ ID NO: 8700 - RNA, 20 nt, Artificial Sequence
  spacer sequence
cuuuaugacagcaauuucac

SEQ ID NO: 8701 - RNA, 20 nt, Artificial Sequence
  spacer sequence
uaaagugaagagcgcaacuu

SEQ ID NO: 8702 - RNA, 20 nt, Artificial Sequence
  spacer sequence
cacuauauuucaccaguguu

SEQ ID NO: 8703 - RNA, 20 nt, Artificial Sequence
  spacer sequence
ccaguguuuauugguguucu

SEQ ID NO: 8704 - RNA, 20 nt, Artificial Sequence
  spacer sequence
gacaucauguaauacauuuu

SEQ ID NO: 8705 - RNA, 20 nt, Artificial Sequence
  spacer sequence
gaacaccaauaaacacuggu

SEQ ID NO: 8706 - RNA, 20 nt, Artificial Sequence
  spacer sequence
uguaauacauuuuaaaaugu

SEQ ID NO: 8707 - RNA, 20 nt, Artificial Sequence
  spacer sequence
augguccuuucagcaacaca

SEQ ID NO: 8708 - RNA, 20 nt, Artificial Sequence
  spacer sequence
uuucagcaacacagcuuuaa

SEQ ID NO: 8709 - RNA, 20 nt, Artificial Sequence
  spacer sequence
gcaacacagcuuuaagacag

SEQ ID NO: 8710 - RNA, 20 nt, Artificial Sequence
  spacer sequence
uaaagcuguguugcugaaag

SEQ ID NO: 8711 - RNA, 20 nt, Artificial Sequence
  spacer sequence
uagccauuguguaaauugcc

SEQ ID NO: 8712 - RNA, 20 nt, Artificial Sequence
  spacer sequence
cagguccuggagccaaacug

SEQ ID NO: 8713 - RNA, 20 nt, Artificial Sequence
  spacer sequence
uggagccaaacugucugcuu

SEQ ID NO: 8714 - RNA, 20 nt, Artificial Sequence
  spacer sequence
aggaccugugaucuuagcca

SEQ ID NO: 8715 - RNA, 20 nt, Artificial Sequence
  spacer sequence
gcuucucccacccgcuuuag

SEQ ID NO: 8716 - RNA, 20 nt, Artificial Sequence
  spacer sequence
cccacccgcuuuaguuagcu

SEQ ID NO: 8717 - RNA, 20 nt, Artificial Sequence
  spacer sequence
cacccgcuuuaguuagcugu

SEQ ID NO: 8718 - RNA, 20 nt, Artificial Sequence
  spacer sequence
cacagcuaacuaaagcgggu

SEQ ID NO: 8719 - RNA, 20 nt, Artificial Sequence
  spacer sequence
aggucacacagcuaacuaaa

SEQ ID NO: 8720 - RNA, 20 nt, Artificial Sequence
  spacer sequence
cuaaaacggcaaagugccaa

SEQ ID NO: 8721 - RNA, 20 nt, Artificial Sequence
  spacer sequence
aaaacggcaaagugccaacc

SEQ ID NO: 8722 - RNA, 20 nt, Artificial Sequence
  spacer sequence
gcauaauuaugugugguugg

SEQ ID NO: 8723 - RNA, 20 nt, Artificial Sequence
  spacer sequence
uuuaaucugcauaauuaugu

SEQ ID NO: 8724 - RNA, 20 nt, Artificial Sequence
  spacer sequence
uaaaaaaaaaaauagcuaac

SEQ ID NO: 8725 - RNA, 20 nt, Artificial Sequence
  spacer sequence
guggcuggggggguuguuaa

SEQ ID NO: 8726 - RNA, 20 nt, Artificial Sequence
  spacer sequence
auggccuguuaggaaacggg

SEQ ID NO: 8727 - RNA, 20 nt, Artificial Sequence
  spacer sequence
uaacaggccauagacuggua

SEQ ID NO: 8728 - RNA, 20 nt, Artificial Sequence
  spacer sequence
ugagcucugccuucugucag

SEQ ID NO: 8729 - RNA, 20 nt, Artificial Sequence
  spacer sequence
ggagguggugcuugcuugcc

SEQ ID NO: 8730 - RNA, 20 nt, Artificial Sequence
  spacer sequence
gccuucugucagaucagcgg

SEQ ID NO: 8731 - RNA, 20 nt, Artificial Sequence
  spacer sequence
gucagaucagcggcagcauu

SEQ ID NO: 8732 - RNA, 20 nt, Artificial Sequence
  spacer sequence
gaucagcggcagcauuagau

SEQ ID NO: 8733 - RNA, 20 nt, Artificial Sequence
  spacer sequence
gacagaaggcagagcucagg

SEQ ID NO: 8734 - RNA, 20 nt, Artificial Sequence
  spacer sequence
gcggcagcauuagauuguca

SEQ ID NO: 8735 - RNA, 20 nt, Artificial Sequence
  spacer sequence
aaugcugccgcugaucugac

SEQ ID NO: 8736 - RNA, 20 nt, Artificial Sequence
  spacer sequence
uaggagcaugaacccugucg

SEQ ID NO: 8737 - RNA, 20 nt, Artificial Sequence
  spacer sequence
uaugacaaucuaaugcugcc

SEQ ID NO: 8738 - RNA, 20 nt, Artificial Sequence
  spacer sequence
ugcuccuaugacaaucuaau

SEQ ID NO: 8739 - RNA, 20 nt, Artificial Sequence
  spacer sequence
ugaaaugcacaugucaggga

SEQ ID NO: 8740 - RNA, 20 nt, Artificial Sequence
  spacer sequence
cgacaggguucaugcuccua

SEQ ID NO: 8741 - RNA, 20 nt, Artificial Sequence
  spacer sequence
gggaucuagcuugugcaguu

SEQ ID NO: 8742 - RNA, 20 nt, Artificial Sequence
  spacer sequence
cugacaugugcauuucacga

SEQ ID NO: 8743 - RNA, 20 nt, Artificial Sequence
  spacer sequence
agcuugugcaguucuuauga

SEQ ID NO: 8744 - RNA, 20 nt, Artificial Sequence
  spacer sequence
uaugagaaucuaacuaaugc

SEQ ID NO: 8745 - RNA, 20 nt, Artificial Sequence
  spacer sequence
uaagaacugcacaagcuaga

SEQ ID NO: 8746 - RNA, 20 nt, Artificial Sequence
  spacer sequence
cauaagaacugcacaagcua

SEQ ID NO: 8747 - RNA, 20 nt, Artificial Sequence
  spacer sequence
aacuaaugccugaugaucug

SEQ ID NO: 8748 - RNA, 20 nt, Artificial Sequence
  spacer sequence
ggcauuaguuagauucucau

SEQ ID NO: 8749 - RNA, 20 nt, Artificial Sequence
  spacer sequence
ucaggcauuaguuagauucu

SEQ ID NO: 8750 - RNA, 20 nt, Artificial Sequence
  spacer sequence
gagguggagcagcuuuaucc

SEQ ID NO: 8751 - RNA, 20 nt, Artificial Sequence
  spacer sequence
gaucaucaggcauuaguuag

SEQ ID NO: 8752 - RNA, 20 nt, Artificial Sequence
  spacer sequence
accucagaucaucaggcauu

SEQ ID NO: 8753 - RNA, 20 nt, Artificial Sequence
  spacer sequence
ugaaaccaucuuccacucca

SEQ ID NO: 8754 - RNA, 20 nt, Artificial Sequence
  spacer sequence
ggauaaagcugcuccaccuc

SEQ ID NO: 8755 - RNA, 20 nt, Artificial Sequence
  spacer sequence
uccacuccaguccauggaaa

SEQ ID NO: 8756 - RNA, 20 nt, Artificial Sequence
  spacer sequence
acuccaguccauggaaaaau

SEQ ID NO: 8757 - RNA, 20 nt, Artificial Sequence
  spacer sequence
aguccauggaaaaauugccu

SEQ ID NO: 8758 - RNA, 20 nt, Artificial Sequence
  spacer sequence
auggaaaaauugccuuccaa

SEQ ID NO: 8759 - RNA, 20 nt, Artificial Sequence
  spacer sequence
auggacuggaguggaagaug

SEQ ID NO: 8760 - RNA, 20 nt, Artificial Sequence
  spacer sequence
aagaaacuggucccuggugc

SEQ ID NO: 8761 - RNA, 20 nt, Artificial Sequence
  spacer sequence
uggaaggcaauuuuuccaug

SEQ ID NO: 8762 - RNA, 20 nt, Artificial Sequence
  spacer sequence
cuggugccggaaagguugga

SEQ ID NO: 8763 - RNA, 20 nt, Artificial Sequence
  spacer sequence
ggcaccagggaccaguuucu

SEQ ID NO: 8764 - RNA, 20 nt, Artificial Sequence
  spacer sequence
aaccuuuccggcaccaggga

SEQ ID NO: 8765 - RNA, 20 nt, Artificial Sequence
  spacer sequence
ccaaccuuuccggcaccagg

SEQ ID NO: 8766 - RNA, 20 nt, Artificial Sequence
  spacer sequence
gaacagaucaggcagcuuuc

SEQ ID NO: 8767 - RNA, 20 nt, Artificial Sequence
  spacer sequence
gauaguggucuccaaccuuu

SEQ ID NO: 8768 - RNA, 20 nt, Artificial Sequence
  spacer sequence
guucagauaguggucuccaa

SEQ ID NO: 8769 - RNA, 20 nt, Artificial Sequence
  spacer sequence
ggcagcuuucuguaaaugag

SEQ ID NO: 8770 - RNA, 20 nt, Artificial Sequence
  spacer sequence
guaaaugagugcugacacac

SEQ ID NO: 8771 - RNA, 20 nt, Artificial Sequence
  spacer sequence
uuuacagaaagcugccugau

SEQ ID NO: 8772 - RNA, 20 nt, Artificial Sequence
  spacer sequence
gcacucauuuacagaaagcu

SEQ ID NO: 8773 - RNA, 20 nt, Artificial Sequence
  spacer sequence
augugugucagcacucauuu

SEQ ID NO: 8774 - RNA, 20 nt, Artificial Sequence
  spacer sequence
aagcaaaauucaaugugugu

SEQ ID NO: 8775 - RNA, 20 nt, Artificial Sequence
  spacer sequence
agugcagguucuaagcaaaa

SEQ ID NO: 8776 - RNA, 20 nt, Artificial Sequence
  spacer sequence
agaaggucagcugaagaguu

SEQ ID NO: 8777 - RNA, 20 nt, Artificial Sequence
  spacer sequence
ggauaugccccuccagugca

SEQ ID NO: 8778 - RNA, 20 nt, Artificial Sequence
  spacer sequence
gcugaagaguuugccaacua

SEQ ID NO: 8779 - RNA, 20 nt, Artificial Sequence
  spacer sequence
gcugaccuucuggauaugcc

SEQ ID NO: 8780 - RNA, 20 nt, Artificial Sequence
  spacer sequence
ucagcugaccuucuggauau

SEQ ID NO: 8781 - RNA, 20 nt, Artificial Sequence
  spacer sequence
ccuaguuggcaaacucuuca

SEQ ID NO: 8782 - RNA, 20 nt, Artificial Sequence
  spacer sequence
auuuaaaucacagccaagaa

SEQ ID NO: 8783 - RNA, 20 nt, Artificial Sequence
  spacer sequence
cagccaagaauguaccaaag

SEQ ID NO: 8784 - RNA, 20 nt, Artificial Sequence
  spacer sequence
uggcugugauuuaaauggac

SEQ ID NO: 8785 - RNA, 20 nt, Artificial Sequence
  spacer sequence
ccucacauugagaaaaugaa

SEQ ID NO: 8786 - RNA, 20 nt, Artificial Sequence
  spacer sequence
cauugagaaaaugaagacac

SEQ ID NO: 8787 - RNA, 20 nt, Artificial Sequence
  spacer sequence
augugaggggaaaacuguau

SEQ ID NO: 8788 - RNA, 20 nt, Artificial Sequence
  spacer sequence
caaugugaggggaaaacugu

SEQ ID NO: 8789 - RNA, 20 nt, Artificial Sequence
  spacer sequence
uuuucucaaugugaggggaa

SEQ ID NO: 8790 - RNA, 20 nt, Artificial Sequence
  spacer sequence
ucauuuucucaaugugaggg

SEQ ID NO: 8791 - RNA, 20 nt, Artificial Sequence
  spacer sequence
cuuucaugauagcucagauu

SEQ ID NO: 8792 - RNA, 20 nt, Artificial Sequence
  spacer sequence
ugauagcucagauuuaucug

SEQ ID NO: 8793 - RNA, 20 nt, Artificial Sequence
  spacer sequence
ugaaagugaauugugucuuc

SEQ ID NO: 8794 - RNA, 20 nt, Artificial Sequence
  spacer sequence
gauuuaucugauucagauuu

SEQ ID NO: 8795 - RNA, 20 nt, Artificial Sequence
  spacer sequence
gagcuaucaugaaagugaau

SEQ ID NO: 8796 - RNA, 20 nt, Artificial Sequence
  spacer sequence
gauucagauuuaaugugaga

SEQ ID NO: 8797 - RNA, 20 nt, Artificial Sequence
  spacer sequence
gauaaaucugagcuaucaug

SEQ ID NO: 8798 - RNA, 20 nt, Artificial Sequence
  spacer sequence
gauuuaaugugagaaacuga

SEQ ID NO: 8799 - RNA, 20 nt, Artificial Sequence
  spacer sequence
gaaucagauaaaucugagcu

SEQ ID NO: 8800 - RNA, 20 nt, Artificial Sequence
  spacer sequence
cauuaaaucugaaucagaua

SEQ ID NO: 8801 - RNA, 20 nt, Artificial Sequence
  spacer sequence
cacauuaaaucugaaucaga

SEQ ID NO: 8802 - RNA, 20 nt, Artificial Sequence
  spacer sequence
guuucucacauuaaaucuga

SEQ ID NO: 8803 - RNA, 20 nt, Artificial Sequence
  spacer sequence
ucaguuucucacauuaaauc

SEQ ID NO: 8804 - RNA, 20 nt, Artificial Sequence
  spacer sequence
uuccucaguuucucacauua

SEQ ID NO: 8805 - RNA, 20 nt, Artificial Sequence
  spacer sequence
uccuuccucaguuucucaca

SEQ ID NO: 8806 - RNA, 20 nt, Artificial Sequence
  spacer sequence
ugucuuccuuccucaguuuc

SEQ ID NO: 8807 - RNA, 20 nt, Artificial Sequence
  spacer sequence
aguagaucacacauagaacu

SEQ ID NO: 8808 - RNA, 20 nt, Artificial Sequence
  spacer sequence
acuggauuuuucuugucuuc

SEQ ID NO: 8809 - RNA, 20 nt, Artificial Sequence
  spacer sequence
cacauagaacuaugggucaa

SEQ ID NO: 8810 - RNA, 20 nt, Artificial Sequence
  spacer sequence
augugugaucuacuggauuu

SEQ ID NO: 8811 - RNA, 20 nt, Artificial Sequence
  spacer sequence
aguucuuauaauuuucaaag

SEQ ID NO: 8812 - RNA, 20 nt, Artificial Sequence
  spacer sequence
uauaauuuucaaaggguuuu

SEQ ID NO: 8813 - RNA, 20 nt, Artificial Sequence
  spacer sequence
aaggguuuuucauuuuucgg

SEQ ID NO: 8814 - RNA, 20 nt, Artificial Sequence
  spacer sequence
uuuuucggcccuuaugacgu

SEQ ID NO: 8815 - RNA, 20 nt, Artificial Sequence
  spacer sequence
gcccuuaugacgugacaaaa

SEQ ID NO: 8816 - RNA, 20 nt, Artificial Sequence
  spacer sequence
uaagggccgaaaaaugaaaa

SEQ ID NO: 8817 - RNA, 20 nt, Artificial Sequence
  spacer sequence
cgucauaagggccgaaaaau

SEQ ID NO: 8818 - RNA, 20 nt, Artificial Sequence
  spacer sequence
guauguuuuuugucacguca

SEQ ID NO: 8819 - RNA, 20 nt, Artificial Sequence
  spacer sequence
cauuuaacccucaaaacaac

SEQ ID NO: 8820 - RNA, 20 nt, Artificial Sequence
  spacer sequence
uuuaacccucaaaacaacuc

SEQ ID NO: 8821 - RNA, 20 nt, Artificial Sequence
  spacer sequence
aaacaacucuaacacaugag

SEQ ID NO: 8822 - RNA, 20 nt, Artificial Sequence
  spacer sequence
aacacaugaggaaugccaaa

SEQ ID NO: 8823 - RNA, 20 nt, Artificial Sequence
  spacer sequence
uguguuagaguuguuuugag

SEQ ID NO: 8824 - RNA, 20 nt, Artificial Sequence
  spacer sequence
ucauguguuagaguuguuuu

SEQ ID NO: 8825 - RNA, 20 nt, Artificial Sequence
  spacer sequence
uggcuuuggcauuccucaug

SEQ ID NO: 8826 - RNA, 20 nt, Artificial Sequence
  spacer sequence
cuuuccuggcuuuggcauuc

SEQ ID NO: 8827 - RNA, 20 nt, Artificial Sequence
  spacer sequence
uauuuguaaaugugcaaauu

SEQ ID NO: 8828 - RNA, 20 nt, Artificial Sequence
  spacer sequence
guuuccuauuuguaaaugug

SEQ ID NO: 8829 - RNA, 20 nt, Artificial Sequence
  spacer sequence
cuuauaagcuucaguuuccu

SEQ ID NO: 8830 - RNA, 20 nt, Artificial Sequence
  spacer sequence
gcaguaugguauuuggcaug

SEQ ID NO: 8831 - RNA, 20 nt, Artificial Sequence
  spacer sequence
guuguuuauauucagcagua

SEQ ID NO: 8832 - RNA, 20 nt, Artificial Sequence
  spacer sequence
acucuguuguuuauauucag

SEQ ID NO: 8833 - RNA, 20 nt, Artificial Sequence
  spacer sequence
caacucuguuguuuauauuc

SEQ ID NO: 8834 - RNA, 20 nt, Artificial Sequence
  spacer sequence
accagaaucuaguauugcuu

SEQ ID NO: 8835 - RNA, 20 nt, Artificial Sequence
  spacer sequence
gguagaacuggguuuaauuc

SEQ ID NO: 8836 - RNA, 20 nt, Artificial Sequence
  spacer sequence
aguauugcuuuucaaguaac

SEQ ID NO: 8837 - RNA, 20 nt, Artificial Sequence
  spacer sequence
aguaacagguuggcugacua

SEQ ID NO: 8838 - RNA, 20 nt, Artificial Sequence
  spacer sequence
gccaaccuguuacuugaaaa

SEQ ID NO: 8839 - RNA, 20 nt, Artificial Sequence
  spacer sequence
agucagccaaccuguuacuu

SEQ ID NO: 8840 - RNA, 20 nt, Artificial Sequence
  spacer sequence
uauuauaaaauauuugcugu

SEQ ID NO: 8841 - RNA, 20 nt, Artificial Sequence
  spacer sequence
ucauguuaaauggcauuuau

SEQ ID NO: 8842 - RNA, 20 nt, Artificial Sequence
  spacer sequence
uguuaaauggcauuuauuau

SEQ ID NO: 8843 - RNA, 20 nt, Artificial Sequence
  spacer sequence
uaauaaaugccauuuaacau

SEQ ID NO: 8844 - RNA, 20 nt, Artificial Sequence
  spacer sequence
auccauuuaaaaauuucaua

SEQ ID NO: 8845 - RNA, 20 nt, Artificial Sequence
  spacer sequence
auuuaaaaauuucauaagga

SEQ ID NO: 8846 - RNA, 20 nt, Artificial Sequence
  spacer sequence
uaaggauagcauccaaggug

SEQ ID NO: 8847 - RNA, 20 nt, Artificial Sequence
  spacer sequence
uuaugaaauuuuuaaaugga

SEQ ID NO: 8848 - RNA, 20 nt, Artificial Sequence
  spacer sequence
aaggugaaaauuaagaaaau

SEQ ID NO: 8849 - RNA, 20 nt, Artificial Sequence
  spacer sequence
ccuuggaugcuauccuuaug

SEQ ID NO: 8850 - RNA, 20 nt, Artificial Sequence
  spacer sequence
uaauuuucaccuuggaugcu

SEQ ID NO: 8851 - RNA, 20 nt, Artificial Sequence
  spacer sequence
cugucccucaaagcagcagc

SEQ ID NO: 8852 - RNA, 20 nt, Artificial Sequence
  spacer sequence
cucaaagcagcagcuuauug

SEQ ID NO: 8853 - RNA, 20 nt, Artificial Sequence
  spacer sequence
aagcagcagcuuauugggua

SEQ ID NO: 8854 - RNA, 20 nt, Artificial Sequence
  spacer sequence
aaguuucuucaggacacaaa

SEQ ID NO: 8855 - RNA, 20 nt, Artificial Sequence
  spacer sequence
ucaggacacaaagucccuga

SEQ ID NO: 8856 - RNA, 20 nt, Artificial Sequence
  spacer sequence
ggacacaaagucccugaaga

SEQ ID NO: 8857 - RNA, 20 nt, Artificial Sequence
  spacer sequence
ugaagaaacuuggauaugua

SEQ ID NO: 8858 - RNA, 20 nt, Artificial Sequence
  spacer sequence
cugaagaaugaagacucaga

SEQ ID NO: 8859 - RNA, 20 nt, Artificial Sequence
  spacer sequence
gggacuuuguguccugaaga

SEQ ID NO: 8860 - RNA, 20 nt, Artificial Sequence
  spacer sequence
ucagggacuuuguguccuga

SEQ ID NO: 8861 - RNA, 20 nt, Artificial Sequence
  spacer sequence
uucuucagggacuuuguguc

SEQ ID NO: 8862 - RNA, 20 nt, Artificial Sequence
  spacer sequence
ucauucuucagggacuuugu

SEQ ID NO: 8863 - RNA, 20 nt, Artificial Sequence
  spacer sequence
gaaaaaaaguaggcagagcc

SEQ ID NO: 8864 - RNA, 20 nt, Artificial Sequence
  spacer sequence
gagucuucauucuucaggga

SEQ ID NO: 8865 - RNA, 20 nt, Artificial Sequence
  spacer sequence
gccuacuuuuuuucugaguc

SEQ ID NO: 8866 - RNA, 20 nt, Artificial Sequence
  spacer sequence
uaggcucugccuacuuuuuu

SEQ ID NO: 8867 - RNA, 20 nt, Artificial Sequence
  spacer sequence
aguuucauaggcucugccua

SEQ ID NO: 8868 - RNA, 20 nt, Artificial Sequence
  spacer sequence
guaucaaguuucauaggcuc

SEQ ID NO: 8869 - RNA, 20 nt, Artificial Sequence
  spacer sequence
ggauggauagauguaagaca

SEQ ID NO: 8870 - RNA, 20 nt, Artificial Sequence
  spacer sequence
agauuauucaguaucaaguu

SEQ ID NO: 8871 - RNA, 20 nt, Artificial Sequence
  spacer sequence
auccagauuauucaguauca

SEQ ID NO: 8872 - RNA, 20 nt, Artificial Sequence
  spacer sequence
auccauccagauuauucagu

SEQ ID NO: 8873 - RNA, 20 nt, Artificial Sequence
  spacer sequence
uacaucuauccauccagauu

SEQ ID NO: 8874 - RNA, 20 nt, Artificial Sequence
  spacer sequence
caccuguaaucccagcacuu

SEQ ID NO: 8875 - RNA, 20 nt, Artificial Sequence
  spacer sequence
cagcacuuugggaggccaag

SEQ ID NO: 8876 - RNA, 20 nt, Artificial Sequence
  spacer sequence
caaagugcugggauuacagg

SEQ ID NO: 8877 - RNA, 20 nt, Artificial Sequence
  spacer sequence
gccugccuuggccucccaaa

SEQ ID NO: 8878 - RNA, 20 nt, Artificial Sequence
  spacer sequence
cuugaggccaggaguuugau

SEQ ID NO: 8879 - RNA, 20 nt, Artificial Sequence
  spacer sequence
agugaucugccugccuuggc

SEQ ID NO: 8880 - RNA, 20 nt, Artificial Sequence
  spacer sequence
uggccucaagugaucugccu

SEQ ID NO: 8881 - RNA, 20 nt, Artificial Sequence
  spacer sequence
aacuccuggccucaagugau

SEQ ID NO: 8882 - RNA, 20 nt, Artificial Sequence
  spacer sequence
uaucaaacuccuggccucaa

SEQ ID NO: 8883 - RNA, 20 nt, Artificial Sequence
  spacer sequence
ccaugcuggccaggcucgua

SEQ ID NO: 8884 - RNA, 20 nt, Artificial Sequence
  spacer sequence
cuacuaaaaauacaaaaauu

SEQ ID NO: 8885 - RNA, 20 nt, Artificial Sequence
  spacer sequence
acuaaaaauacaaaaauuag

SEQ ID NO: 8886 - RNA, 20 nt, Artificial Sequence
  spacer sequence
uguaaucccagcuauucagg

SEQ ID NO: 8887 - RNA, 20 nt, Artificial Sequence
  spacer sequence
cagcuauucagguggcugag

SEQ ID NO: 8888 - RNA, 20 nt, Artificial Sequence
  spacer sequence
gguggcugaggcaagagggu

SEQ ID NO: 8889 - RNA, 20 nt, Artificial Sequence
  spacer sequence
gccaccugaauagcugggau

SEQ ID NO: 8890 - RNA, 20 nt, Artificial Sequence
  spacer sequence
ugccucagccaccugaauag

SEQ ID NO: 8891 - RNA, 20 nt, Artificial Sequence
  spacer sequence
gcuugaaucugggaggugga

SEQ ID NO: 8892 - RNA, 20 nt, Artificial Sequence
  spacer sequence
agccgacccucuugccucag

SEQ ID NO: 8893 - RNA, 20 nt, Artificial Sequence
  spacer sequence
gggagguggaaguugcagug

SEQ ID NO: 8894 - RNA, 20 nt, Artificial Sequence
  spacer sequence
cagauucaagccgacccucu

SEQ ID NO: 8895 - RNA, 20 nt, Artificial Sequence
  spacer sequence
accucccagauucaagccga

SEQ ID NO: 8896 - RNA, 20 nt, Artificial Sequence
  spacer sequence
cugcaacuuccaccucccag

SEQ ID NO: 8897 - RNA, 20 nt, Artificial Sequence
  spacer sequence
ccaccacauuccagcuuggg

SEQ ID NO: 8898 - RNA, 20 nt, Artificial Sequence
  spacer sequence
agcuugggcaacaaagagag

SEQ ID NO: 8899 - RNA, 20 nt, Artificial Sequence
  spacer sequence
uuguugcccaagcuggaaug

SEQ ID NO: 8900 - RNA, 20 nt, Artificial Sequence
  spacer sequence
cuuuguugcccaagcuggaa

SEQ ID NO: 8901 - RNA, 20 nt, Artificial Sequence
  spacer sequence
cucuuuguugcccaagcugg

SEQ ID NO: 8902 - RNA, 20 nt, Artificial Sequence
  spacer sequence
gucucaaaaaaaaaaaaaaa

SEQ ID NO: 8903 - RNA, 20 nt, Artificial Sequence
  spacer sequence
caaaaaaaaaaaaaaaaaaa

SEQ ID NO: 8904 - RNA, 20 nt, Artificial Sequence
  spacer sequence
aaaaaaaaaaaaaaaaaaaa

SEQ ID NO: 8905 - RNA, 20 nt, Artificial Sequence
  spacer sequence
cuuuuuuuuuuuuuuuuuuu

SEQ ID NO: 8906 - RNA, 20 nt, Artificial Sequence
  spacer sequence
ucacuuuuuuuuuuuuuuuu

SEQ ID NO: 8907 - RNA, 20 nt, Artificial Sequence
  spacer sequence
gauaaaacaugaaaaaugua

SEQ ID NO: 8908 - RNA, 20 nt, Artificial Sequence
  spacer sequence
gauuuaaauuuuauauucuu

SEQ ID NO: 8909 - RNA, 20 nt, Artificial Sequence
  spacer sequence
uguuuuaucagauuuaaauu

SEQ ID NO: 8910 - RNA, 20 nt, Artificial Sequence
  spacer sequence
uguuuuuuacuaugaaucca

SEQ ID NO: 8911 - RNA, 20 nt, Artificial Sequence
  spacer sequence
uaguaaaaaacaugaguaca

SEQ ID NO: 8912 - RNA, 20 nt, Artificial Sequence
  spacer sequence
agacauauaucuacaguaag

SEQ ID NO: 8913 - RNA, 20 nt, Artificial Sequence
  spacer sequence
ggauucauaguaaaaaacau

SEQ ID NO: 8914 - RNA, 20 nt, Artificial Sequence
  spacer sequence
acaguaagauuuagaaaggg

SEQ ID NO: 8915 - RNA, 20 nt, Artificial Sequence
  spacer sequence
uacuguagauauaugucugg

SEQ ID NO: 8916 - RNA, 20 nt, Artificial Sequence
  spacer sequence
aaaucuuacuguagauauau

SEQ ID NO: 8917 - RNA, 20 nt, Artificial Sequence
  spacer sequence
cuuucuaaaucuuacuguag

SEQ ID NO: 8918 - RNA, 20 nt, Artificial Sequence
  spacer sequence
ggcacuuaaaguuuaaguca

SEQ ID NO: 8919 - RNA, 20 nt, Artificial Sequence
  spacer sequence
ugucccaauauucucaccug

SEQ ID NO: 8920 - RNA, 20 nt, Artificial Sequence
  spacer sequence
caauauucucaccuguggag

SEQ ID NO: 8921 - RNA, 20 nt, Artificial Sequence
  spacer sequence
caccuguggagguggcacug

SEQ ID NO: 8922 - RNA, 20 nt, Artificial Sequence
  spacer sequence
ccuguggagguggcacuguu

SEQ ID NO: 8923 - RNA, 20 nt, Artificial Sequence
  spacer sequence
acaggugagaauauugggac

SEQ ID NO: 8924 - RNA, 20 nt, Artificial Sequence
  spacer sequence
ugcaccuauaacagugccac

SEQ ID NO: 8925 - RNA, 20 nt, Artificial Sequence
  spacer sequence
uguuccugcaccuauaacag

SEQ ID NO: 8926 - RNA, 20 nt, Artificial Sequence
  spacer sequence
uauuccuguuccugcaccua

SEQ ID NO: 8927 - RNA, 20 nt, Artificial Sequence
  spacer sequence
cuccuauuccuguuccugca

SEQ ID NO: 8928 - RNA, 20 nt, Artificial Sequence
  spacer sequence
cccauaccuaaaccauuacc

SEQ ID NO: 8929 - RNA, 20 nt, Artificial Sequence
  spacer sequence
gugugugagguuucagcacc

SEQ ID NO: 8930 - RNA, 20 nt, Artificial Sequence
  spacer sequence
cacacagaaccaguaucacc

SEQ ID NO: 8931 - RNA, 20 nt, Artificial Sequence
  spacer sequence
gcaccuccauuuugagcaac

SEQ ID NO: 8932 - RNA, 20 nt, Artificial Sequence
  spacer sequence
auuuugagcaacuucauuuu

SEQ ID NO: 8933 - RNA, 20 nt, Artificial Sequence
  spacer sequence
aaauggaggugcugaaaccu

SEQ ID NO: 8934 - RNA, 20 nt, Artificial Sequence
  spacer sequence
uuuucaggcuucuuaggaau

SEQ ID NO: 8935 - RNA, 20 nt, Artificial Sequence
  spacer sequence
ggcuucuuaggaauuccuuu

SEQ ID NO: 8936 - RNA, 20 nt, Artificial Sequence
  spacer sequence
uaggaauuccuuuccaaucu

SEQ ID NO: 8937 - RNA, 20 nt, Artificial Sequence
  spacer sequence
uaagaagccugaaaaugaag

SEQ ID NO: 8938 - RNA, 20 nt, Artificial Sequence
  spacer sequence
uuuccaaucugugagcguga

SEQ ID NO: 8939 - RNA, 20 nt, Artificial Sequence
  spacer sequence
aaucugugagcgugaaagaa

SEQ ID NO: 8940 - RNA, 20 nt, Artificial Sequence
  spacer sequence
gugagcgugaaagaaauuua

SEQ ID NO: 8941 - RNA, 20 nt, Artificial Sequence
  spacer sequence
cagauuggaaaggaauuccu

SEQ ID NO: 8942 - RNA, 20 nt, Artificial Sequence
  spacer sequence
cgcucacagauuggaaagga

SEQ ID NO: 8943 - RNA, 20 nt, Artificial Sequence
  spacer sequence
uucacgcucacagauuggaa

SEQ ID NO: 8944 - RNA, 20 nt, Artificial Sequence
  spacer sequence
uguuaaauuucuuucacgcu

SEQ ID NO: 8945 - RNA, 20 nt, Artificial Sequence
  spacer sequence
guuuguaacuuuaaaucuag

SEQ ID NO: 8946 - RNA, 20 nt, Artificial Sequence
  spacer sequence
agaaaugaaaaauguugauu

SEQ ID NO: 8947 - RNA, 20 nt, Artificial Sequence
  spacer sequence
agauuuaaaguuacaaacug

SEQ ID NO: 8948 - RNA, 20 nt, Artificial Sequence
  spacer sequence
uuucuagauuuaaaguuaca

SEQ ID NO: 8949 - RNA, 20 nt, Artificial Sequence
  spacer sequence
acauuuuucauuucuagauu

SEQ ID NO: 8950 - RNA, 20 nt, Artificial Sequence
  spacer sequence
uuaauaacugggcuagguuu

SEQ ID NO: 8951 - RNA, 20 nt, Artificial Sequence
  spacer sequence
caugcuaauuuuagaaauag

SEQ ID NO: 8952 - RNA, 20 nt, Artificial Sequence
  spacer sequence
aaaauuagcaugggaauuuc

SEQ ID NO: 8953 - RNA, 20 nt, Artificial Sequence
  spacer sequence
auuguuguuaauuuaaauaa

SEQ ID NO: 8954 - RNA, 20 nt, Artificial Sequence
  spacer sequence
uuuacauguuucuauuguug

SEQ ID NO: 8955 - RNA, 20 nt, Artificial Sequence
  spacer sequence
caagcacucuauuuauacua

SEQ ID NO: 8956 - RNA, 20 nt, Artificial Sequence
  spacer sequence
auuuauacuagcuuauuuag

SEQ ID NO: 8957 - RNA, 20 nt, Artificial Sequence
  spacer sequence
cacaaccauuuacaaguaga

SEQ ID NO: 8958 - RNA, 20 nt, Artificial Sequence
  spacer sequence
caaccauuuacaaguagaua

SEQ ID NO: 8959 - RNA, 20 nt, Artificial Sequence
  spacer sequence
acuuguaaaugguugugaga

SEQ ID NO: 8960 - RNA, 20 nt, Artificial Sequence
  spacer sequence
cauuucacaaaugagaaaag

SEQ ID NO: 8961 - RNA, 20 nt, Artificial Sequence
  spacer sequence
caaaugagaaaagcaaagac

SEQ ID NO: 8962 - RNA, 20 nt, Artificial Sequence
  spacer sequence
uuugugaaaugggaauaaua

SEQ ID NO: 8963 - RNA, 20 nt, Artificial Sequence
  spacer sequence
cauuugugaaaugggaauaa

SEQ ID NO: 8964 - RNA, 20 nt, Artificial Sequence
  spacer sequence
uugcuuuucucauuugugaa

SEQ ID NO: 8965 - RNA, 20 nt, Artificial Sequence
  spacer sequence
ugggcaagcugucuuugcuu

SEQ ID NO: 8966 - RNA, 20 nt, Artificial Sequence
  spacer sequence
cauucuugguaaauggcagg

SEQ ID NO: 8967 - RNA, 20 nt, Artificial Sequence
  spacer sequence
ugguaaauggcagggacgga

SEQ ID NO: 8968 - RNA, 20 nt, Artificial Sequence
  spacer sequence
cugccauuuaccaagaaugu

SEQ ID NO: 8969 - RNA, 20 nt, Artificial Sequence
  spacer sequence
gucccugccauuuaccaaga

SEQ ID NO: 8970 - RNA, 20 nt, Artificial Sequence
  spacer sequence
acucagacacauuugguucu

SEQ ID NO: 8971 - RNA, 20 nt, Artificial Sequence
  spacer sequence
gacacauuugguucuagagu

SEQ ID NO: 8972 - RNA, 20 nt, Artificial Sequence
  spacer sequence
gaguugaauccgucccugcc

SEQ ID NO: 8973 - RNA, 20 nt, Artificial Sequence
  spacer sequence
agaguccauguucuuaacca

SEQ ID NO: 8974 - RNA, 20 nt, Artificial Sequence
  spacer sequence
agaaccaaaugugucugagu

SEQ ID NO: 8975 - RNA, 20 nt, Artificial Sequence
  spacer sequence
auguucuuaaccacaagaau

SEQ ID NO: 8976 - RNA, 20 nt, Artificial Sequence
  spacer sequence
uaaccacaagaauguauuau

SEQ ID NO: 8977 - RNA, 20 nt, Artificial Sequence
  spacer sequence
ugugguuaagaacauggacu

SEQ ID NO: 8978 - RNA, 20 nt, Artificial Sequence
  spacer sequence
aauacuuuaaauaauacauu

SEQ ID NO: 8979 - RNA, 20 nt, Artificial Sequence
  spacer sequence
uuuauuucuaauacuuuaaa

SEQ ID NO: 8980 - RNA, 20 nt, Artificial Sequence
  spacer sequence
uuauccuuuauuucuaauac

SEQ ID NO: 8981 - RNA, 20 nt, Artificial Sequence
  spacer sequence
ugaacacauuucacuaauau

SEQ ID NO: 8982 - RNA, 20 nt, Artificial Sequence
  spacer sequence
ggaaauauuggguguuucau

SEQ ID NO: 8983 - RNA, 20 nt, Artificial Sequence
  spacer sequence
cuaauauuaaagaauaacuu

SEQ ID NO: 8984 - RNA, 20 nt, Artificial Sequence
  spacer sequence
uuaauauuagugaaaugugu

SEQ ID NO: 8985 - RNA, 20 nt, Artificial Sequence
  spacer sequence
caccuauuuccacauaucuu

SEQ ID NO: 8986 - RNA, 20 nt, Artificial Sequence
  spacer sequence
acauaucuucuagucaagug

SEQ ID NO: 8987 - RNA, 20 nt, Artificial Sequence
  spacer sequence
cccucaccgcccucagaaag

SEQ ID NO: 8988 - RNA, 20 nt, Artificial Sequence
  spacer sequence
cgccuguaaucccagcacuu

SEQ ID NO: 8989 - RNA, 20 nt, Artificial Sequence
  spacer sequence
cagcacuuugggaggcugag

SEQ ID NO: 8990 - RNA, 20 nt, Artificial Sequence
  spacer sequence
caaagugcugggauuacagg

SEQ ID NO: 8991 - RNA, 20 nt, Artificial Sequence
  spacer sequence
gccucccaaagugcugggau

SEQ ID NO: 8992 - RNA, 20 nt, Artificial Sequence
  spacer sequence
gccuacugccucagccuccc

SEQ ID NO: 8993 - RNA, 20 nt, Artificial Sequence
  spacer sequence
ccugaggucaggaguucgag

SEQ ID NO: 8994 - RNA, 20 nt, Artificial Sequence
  spacer sequence
ggugaucugccuacugccuc

SEQ ID NO: 8995 - RNA, 20 nt, Artificial Sequence
  spacer sequence
ggaguucgaggccagccuaa

SEQ ID NO: 8996 - RNA, 20 nt, Artificial Sequence
  spacer sequence
ugaccucaggugaucugccu

SEQ ID NO: 8997 - RNA, 20 nt, Artificial Sequence
  spacer sequence
aggccagccuaacaugguga

SEQ ID NO: 8998 - RNA, 20 nt, Artificial Sequence
  spacer sequence
aacuccugaccucaggugau

SEQ ID NO: 8999 - RNA, 20 nt, Artificial Sequence
  spacer sequence
uugucuuacacguuuacuuu

SEQ ID NO: 9000 - RNA, 20 nt, Artificial Sequence
  spacer sequence
uacacguuuacuuuagauug

SEQ ID NO: 9001 - RNA, 20 nt, Artificial Sequence
  spacer sequence
aaaguaaacguguaagacaa

SEQ ID NO: 9002 - RNA, 20 nt, Artificial Sequence
  spacer sequence
cuggacaucuaaaacuuucc

SEQ ID NO: 9003 - RNA, 20 nt, Artificial Sequence
  spacer sequence
ggacaucuaaaacuuuccaa

SEQ ID NO: 9004 - RNA, 20 nt, Artificial Sequence
  spacer sequence
agagaagcaaucuaaaguaa

SEQ ID NO: 9005 - RNA, 20 nt, Artificial Sequence
  spacer sequence
aaaacuuuccaagguaauua

SEQ ID NO: 9006 - RNA, 20 nt, Artificial Sequence
  spacer sequence
aagguaauuaucaugaagca

SEQ ID NO: 9007 - RNA, 20 nt, Artificial Sequence
  spacer sequence
ugaagcacuggauuaaaacc

SEQ ID NO: 9008 - RNA, 20 nt, Artificial Sequence
  spacer sequence
ugauaauuaccuuggaaagu

SEQ ID NO: 9009 - RNA, 20 nt, Artificial Sequence
  spacer sequence
agugcuucaugauaauuacc

SEQ ID NO: 9010 - RNA, 20 nt, Artificial Sequence
  spacer sequence
ggagacugaaggaggagagu

SEQ ID NO: 9011 - RNA, 20 nt, Artificial Sequence
  spacer sequence
cgaguagcugggacuacagg

SEQ ID NO: 9012 - RNA, 20 nt, Artificial Sequence
  spacer sequence
cccgaguagcugggacuaca

SEQ ID NO: 9013 - RNA, 20 nt, Artificial Sequence
  spacer sequence
gucucccgaguagcugggac

SEQ ID NO: 9014 - RNA, 20 nt, Artificial Sequence
  spacer sequence
uucagucucccgaguagcug

SEQ ID NO: 9015 - RNA, 20 nt, Artificial Sequence
  spacer sequence
uccuucagucucccgaguag

SEQ ID NO: 9016 - RNA, 20 nt, Artificial Sequence
  spacer sequence
ccuccuucagucucccgagu

SEQ ID NO: 9017 - RNA, 20 nt, Artificial Sequence
  spacer sequence
agccacucuccuccuucagu

SEQ ID NO: 9018 - RNA, 20 nt, Artificial Sequence
  spacer sequence
cagguucaagccacucuccu

SEQ ID NO: 9019 - RNA, 20 nt, Artificial Sequence
  spacer sequence
gccucccagguucaagccac

SEQ ID NO: 9020 - RNA, 20 nt, Artificial Sequence
  spacer sequence
cugcaaccucugccucccag

SEQ ID NO: 9021 - RNA, 20 nt, Artificial Sequence
  spacer sequence
ugggucacugcaaccucugc

SEQ ID NO: 9022 - RNA, 20 nt, Artificial Sequence
  spacer sequence
cuacacuccagccugggcua

SEQ ID NO: 9023 - RNA, 20 nt, Artificial Sequence
  spacer sequence
agccugggcuacagagacuc

SEQ ID NO: 9024 - RNA, 20 nt, Artificial Sequence
  spacer sequence
guagcccaggcuggagugua

SEQ ID NO: 9025 - RNA, 20 nt, Artificial Sequence
  spacer sequence
cuguagcccaggcuggagug

SEQ ID NO: 9026 - RNA, 20 nt, Artificial Sequence
  spacer sequence
accucaaaaaauaaauaaaa

SEQ ID NO: 9027 - RNA, 20 nt, Artificial Sequence
  spacer sequence
aaaaauaaauaaaaaaaaac

SEQ ID NO: 9028 - RNA, 20 nt, Artificial Sequence
  spacer sequence
uugguauuauguuuuuuuuu

SEQ ID NO: 9029 - RNA, 20 nt, Artificial Sequence
  spacer sequence
guuaagaccuauaugauuua

SEQ ID NO: 9030 - RNA, 20 nt, Artificial Sequence
  spacer sequence
uaacugagcaucuuugguau

SEQ ID NO: 9031 - RNA, 20 nt, Artificial Sequence
  spacer sequence
cuuauuugcuugguaguaca

SEQ ID NO: 9032 - RNA, 20 nt, Artificial Sequence
  spacer sequence
uacaguucacuuauuugcuu

SEQ ID NO: 9033 - RNA, 20 nt, Artificial Sequence
  spacer sequence
cuuacaguucacuuauuugc

SEQ ID NO: 9034 - RNA, 20 nt, Artificial Sequence
  spacer sequence
cuguccaacauuccuccuuc

SEQ ID NO: 9035 - RNA, 20 nt, Artificial Sequence
  spacer sequence
aacauuccuccuucacaaaa

SEQ ID NO: 9036 - RNA, 20 nt, Artificial Sequence
  spacer sequence
uccuucacaaaaacucucca

SEQ ID NO: 9037 - RNA, 20 nt, Artificial Sequence
  spacer sequence
uucacaaaaacucuccaguu

SEQ ID NO: 9038 - RNA, 20 nt, Artificial Sequence
  spacer sequence
caaaaacucuccaguuccuc

SEQ ID NO: 9039 - RNA, 20 nt, Artificial Sequence
  spacer sequence
ccaguuccucaggcuugacu

SEQ ID NO: 9040 - RNA, 20 nt, Artificial Sequence
  spacer sequence
aguuccucaggcuugacuuu

SEQ ID NO: 9041 - RNA, 20 nt, Artificial Sequence
  spacer sequence
ucaggcuugacuuuguccca

SEQ ID NO: 9042 - RNA, 20 nt, Artificial Sequence
  spacer sequence
ggcuugacuuugucccaugg

SEQ ID NO: 9043 - RNA, 20 nt, Artificial Sequence
  spacer sequence
agccugaggaacuggagagu

SEQ ID NO: 9044 - RNA, 20 nt, Artificial Sequence
  spacer sequence
cauggaauauaaguaacacc

SEQ ID NO: 9045 - RNA, 20 nt, Artificial Sequence
  spacer sequence
augggacaaagucaagccug

SEQ ID NO: 9046 - RNA, 20 nt, Artificial Sequence
  spacer sequence
acaucccaauacugcuuaua

SEQ ID NO: 9047 - RNA, 20 nt, Artificial Sequence
  spacer sequence
caauacugcuuauaaucugc

SEQ ID NO: 9048 - RNA, 20 nt, Artificial Sequence
  spacer sequence
gccuuuauuccuuuguuuaa

SEQ ID NO: 9049 - RNA, 20 nt, Artificial Sequence
  spacer sequence
uuuguuuaaggcccaggcaa

SEQ ID NO: 9050 - RNA, 20 nt, Artificial Sequence
  spacer sequence
auuucaccauuagugaaaau

SEQ ID NO: 9051 - RNA, 20 nt, Artificial Sequence
  spacer sequence
ccauuagugaaaauauaaaa

SEQ ID NO: 9052 - RNA, 20 nt, Artificial Sequence
  spacer sequence
cuaauggugaaauagauugc

SEQ ID NO: 9053 - RNA, 20 nt, Artificial Sequence
  spacer sequence
uuuuauauuuucacuaaugg

SEQ ID NO: 9054 - RNA, 20 nt, Artificial Sequence
  spacer sequence
uaagucuugaggguauuauu

SEQ ID NO: 9055 - RNA, 20 nt, Artificial Sequence
  spacer sequence
ugaggguauuauucucuauc

SEQ ID NO: 9056 - RNA, 20 nt, Artificial Sequence
  spacer sequence
ccaccuuuggugaauauuuu

SEQ ID NO: 9057 - RNA, 20 nt, Artificial Sequence
  spacer sequence
accuuuggugaauauuuuuc

SEQ ID NO: 9058 - RNA, 20 nt, Artificial Sequence
  spacer sequence
ccaaagguggagaaaaacau

SEQ ID NO: 9059 - RNA, 20 nt, Artificial Sequence
  spacer sequence
guuaauucuaagauggcaaa

SEQ ID NO: 9060 - RNA, 20 nt, Artificial Sequence
  spacer sequence
aagauggcaaacuuuaaaaa

SEQ ID NO: 9061 - RNA, 20 nt, Artificial Sequence
  spacer sequence
uagaauuaacugaaaaauau

SEQ ID NO: 9062 - RNA, 20 nt, Artificial Sequence
  spacer sequence
aaauuuuuugaacaggacaa

SEQ ID NO: 9063 - RNA, 20 nt, Artificial Sequence
  spacer sequence
ugguaaauuagugcuuuaaa

SEQ ID NO: 9064 - RNA, 20 nt, Artificial Sequence
  spacer sequence
ucaugguaaauuagugcuuu

SEQ ID NO: 9065 - RNA, 20 nt, Artificial Sequence
  spacer sequence
acauuuaggaaaaacaaaac

SEQ ID NO: 9066 - RNA, 20 nt, Artificial Sequence
  spacer sequence
uaaauguagauggguucauc

SEQ ID NO: 9067 - RNA, 20 nt, Artificial Sequence
  spacer sequence
accaugcacguaacauuuac

SEQ ID NO: 9068 - RNA, 20 nt, Artificial Sequence
  spacer sequence
uacauguuauaauuaauuuu

SEQ ID NO: 9069 - RNA, 20 nt, Artificial Sequence
  spacer sequence
auaaagguacagucuuacau

SEQ ID NO: 9070 - RNA, 20 nt, Artificial Sequence
  spacer sequence
gguucacuuuauaguuuccu

SEQ ID NO: 9071 - RNA, 20 nt, Artificial Sequence
  spacer sequence
cuuuauaguuuccucggcuc

SEQ ID NO: 9072 - RNA, 20 nt, Artificial Sequence
  spacer sequence
ucggcucaguuucugcaggg

SEQ ID NO: 9073 - RNA, 20 nt, Artificial Sequence
  spacer sequence
gcucaguuucugcagggcac

SEQ ID NO: 9074 - RNA, 20 nt, Artificial Sequence
  spacer sequence
guuucugcagggcacgauag

SEQ ID NO: 9075 - RNA, 20 nt, Artificial Sequence
  spacer sequence
gcagggcacgauaggcaucu

SEQ ID NO: 9076 - RNA, 20 nt, Artificial Sequence
  spacer sequence
ugcccugcagaaacugagcc

SEQ ID NO: 9077 - RNA, 20 nt, Artificial Sequence
  spacer sequence
ugccuaugaaccauaacaau

SEQ ID NO: 9078 - RNA, 20 nt, Artificial Sequence
  spacer sequence
uaggcaagaugccuaucgug

SEQ ID NO: 9079 - RNA, 20 nt, Artificial Sequence
  spacer sequence
cagggguugugccuauauug

SEQ ID NO: 9080 - RNA, 20 nt, Artificial Sequence
  spacer sequence
ucccagggguugugccuaua

SEQ ID NO: 9081 - RNA, 20 nt, Artificial Sequence
  spacer sequence
ucugcuccaaaacauuuuaa

SEQ ID NO: 9082 - RNA, 20 nt, Artificial Sequence
  spacer sequence
gcuccaaaacauuuuaauau

SEQ ID NO: 9083 - RNA, 20 nt, Artificial Sequence
  spacer sequence
aaaacauuuuaauauuauaa

SEQ ID NO: 9084 - RNA, 20 nt, Artificial Sequence
  spacer sequence
uuuauaauauuaaaauguuu

SEQ ID NO: 9085 - RNA, 20 nt, Artificial Sequence
  spacer sequence
auuuuguuaucuuuuauaau

SEQ ID NO: 9086 - RNA, 20 nt, Artificial Sequence
  spacer sequence
caccuguccaucguacuuaa

SEQ ID NO: 9087 - RNA, 20 nt, Artificial Sequence
  spacer sequence
aucguacuuaaaaaacugaa

SEQ ID NO: 9088 - RNA, 20 nt, Artificial Sequence
  spacer sequence
uacuuaaaaaacugaauaaa

SEQ ID NO: 9089 - RNA, 20 nt, Artificial Sequence
  spacer sequence
guuuuuuaaguacgauggac

SEQ ID NO: 9090 - RNA, 20 nt, Artificial Sequence
  spacer sequence
cauuaauugauucaauugga

SEQ ID NO: 9091 - RNA, 20 nt, Artificial Sequence
  spacer sequence
auuaaugugaguguuuauuc

SEQ ID NO: 9092 - RNA, 20 nt, Artificial Sequence
  spacer sequence
auuggaccaaacucuuccaa

SEQ ID NO: 9093 - RNA, 20 nt, Artificial Sequence
  spacer sequence
aauugaaucaauuaauguga

SEQ ID NO: 9094 - RNA, 20 nt, Artificial Sequence
  spacer sequence
uccaagagacuggcaacauc

SEQ ID NO: 9095 - RNA, 20 nt, Artificial Sequence
  spacer sequence
aagagacuggcaacauccug

SEQ ID NO: 9096 - RNA, 20 nt, Artificial Sequence
  spacer sequence
uggaagaguuugguccaauu

SEQ ID NO: 9097 - RNA, 20 nt, Artificial Sequence
  spacer sequence
cuuggaagaguuugguccaa

SEQ ID NO: 9098 - RNA, 20 nt, Artificial Sequence
  spacer sequence
ugcugaguaguucuuuuguc

SEQ ID NO: 9099 - RNA, 20 nt, Artificial Sequence
  spacer sequence
gcaggauguugccagucucu

SEQ ID NO: 9100 - RNA, 20 nt, Artificial Sequence
  spacer sequence
uuuguccagcugccccaccc

SEQ ID NO: 9101 - RNA, 20 nt, Artificial Sequence
  spacer sequence
agcugccccacccagagggu

SEQ ID NO: 9102 - RNA, 20 nt, Artificial Sequence
  spacer sequence
ggguggggcagcuggacaaa

SEQ ID NO: 9103 - RNA, 20 nt, Artificial Sequence
  spacer sequence
uaaagagauucacauuugau

SEQ ID NO: 9104 - RNA, 20 nt, Artificial Sequence
  spacer sequence
uuaugauuguaauuuuauuu

SEQ ID NO: 9105 - RNA, 20 nt, Artificial Sequence
  spacer sequence
cuuuaugauuguaauuuuau

SEQ ID NO: 9106 - RNA, 20 nt, Artificial Sequence
  spacer sequence
cauuugauaaugagcagcac

SEQ ID NO: 9107 - RNA, 20 nt, Artificial Sequence
  spacer sequence
aaugugaaucucuuuaugau

SEQ ID NO: 9108 - RNA, 20 nt, Artificial Sequence
  spacer sequence
cccugccaaugaacagcaga

SEQ ID NO: 9109 - RNA, 20 nt, Artificial Sequence
  spacer sequence
uuggcagggugaggugggca

SEQ ID NO: 9110 - RNA, 20 nt, Artificial Sequence
  spacer sequence
gcuguucauuggcaggguga

SEQ ID NO: 9111 - RNA, 20 nt, Artificial Sequence
  spacer sequence
uaguucugcuguucauuggc

SEQ ID NO: 9112 - RNA, 20 nt, Artificial Sequence
  spacer sequence
aauccuaguucugcuguuca

SEQ ID NO: 9113 - RNA, 20 nt, Artificial Sequence
  spacer sequence
agucucuugauuaccaacca

SEQ ID NO: 9114 - RNA, 20 nt, Artificial Sequence
  spacer sequence
cuugauuaccaaccagcuca

SEQ ID NO: 9115 - RNA, 20 nt, Artificial Sequence
  spacer sequence
ugauuaccaaccagcucagu

SEQ ID NO: 9116 - RNA, 20 nt, Artificial Sequence
  spacer sequence
agagacuugagcuccaaucc

SEQ ID NO: 9117 - RNA, 20 nt, Artificial Sequence
  spacer sequence
gugcuuuguucacuugcaug

SEQ ID NO: 9118 - RNA, 20 nt, Artificial Sequence
  spacer sequence
uugauguauacccuuagauu

SEQ ID NO: 9119 - RNA, 20 nt, Artificial Sequence
  spacer sequence
ugugccuuguuuauucauug

SEQ ID NO: 9120 - RNA, 20 nt, Artificial Sequence
  spacer sequence
aauaaaaaucaacacagugg

SEQ ID NO: 9121 - RNA, 20 nt, Artificial Sequence
  spacer sequence
acacagugguaacauuucuu

SEQ ID NO: 9122 - RNA, 20 nt, Artificial Sequence
  spacer sequence
uuuauaguuuugcuaacagu

SEQ ID NO: 9123 - RNA, 20 nt, Artificial Sequence
  spacer sequence
uguacuauuuuuucaugucu

SEQ ID NO: 9124 - RNA, 20 nt, Artificial Sequence
  spacer sequence
aaccucauguacuauuuuuu

SEQ ID NO: 9125 - RNA, 20 nt, Artificial Sequence
  spacer sequence
accuuuauauucaaaccuca

SEQ ID NO: 9126 - RNA, 20 nt, Artificial Sequence
  spacer sequence
gguuucacuugagggaggcc

SEQ ID NO: 9127 - RNA, 20 nt, Artificial Sequence
  spacer sequence
cuugagggaggccuuuuugu

SEQ ID NO: 9128 - RNA, 20 nt, Artificial Sequence
  spacer sequence
agugaaaccggaaacugcaa

SEQ ID NO: 9129 - RNA, 20 nt, Artificial Sequence
  spacer sequence
cucaagugaaaccggaaacu

SEQ ID NO: 9130 - RNA, 20 nt, Artificial Sequence
  spacer sequence
acguucucucucuuuuucuc

SEQ ID NO: 9131 - RNA, 20 nt, Artificial Sequence
  spacer sequence
acaaaaaggccucccucaag

SEQ ID NO: 9132 - RNA, 20 nt, Artificial Sequence
  spacer sequence
cucucuuuuucucgaucccg

SEQ ID NO: 9133 - RNA, 20 nt, Artificial Sequence
  spacer sequence
cucuuuuucucgaucccguc

SEQ ID NO: 9134 - RNA, 20 nt, Artificial Sequence
  spacer sequence
cuuuuucucgaucccgucuu

SEQ ID NO: 9135 - RNA, 20 nt, Artificial Sequence
  spacer sequence
uuuucucgaucccgucuuuc

SEQ ID NO: 9136 - RNA, 20 nt, Artificial Sequence
  spacer sequence
cgaucccgucuuucuugaga

SEQ ID NO: 9137 - RNA, 20 nt, Artificial Sequence
  spacer sequence
aucccgucuuucuugagauc

SEQ ID NO: 9138 - RNA, 20 nt, Artificial Sequence
  spacer sequence
agaaaaagagagagaacguc

SEQ ID NO: 9139 - RNA, 20 nt, Artificial Sequence
  spacer sequence
cgucuuucuugagaucgaga

SEQ ID NO: 9140 - RNA, 20 nt, Artificial Sequence
  spacer sequence
uucuugagaucgagaucggg

SEQ ID NO: 9141 - RNA, 20 nt, Artificial Sequence
  spacer sequence
ugagaucgagaucggggaga

SEQ ID NO: 9142 - RNA, 20 nt, Artificial Sequence
  spacer sequence
agaaagacgggaucgagaaa

SEQ ID NO: 9143 - RNA, 20 nt, Artificial Sequence
  spacer sequence
caagaaagacgggaucgaga

SEQ ID NO: 9144 - RNA, 20 nt, Artificial Sequence
  spacer sequence
agaucggggagaaugucggc

SEQ ID NO: 9145 - RNA, 20 nt, Artificial Sequence
  spacer sequence
aucucaagaaagacgggauc

SEQ ID NO: 9146 - RNA, 20 nt, Artificial Sequence
  spacer sequence
cgaucucaagaaagacggga

SEQ ID NO: 9147 - RNA, 20 nt, Artificial Sequence
  spacer sequence
gggagaaugucggcgucuau

SEQ ID NO: 9148 - RNA, 20 nt, Artificial Sequence
  spacer sequence
ccgaucucgaucucaagaaa

SEQ ID NO: 9149 - RNA, 20 nt, Artificial Sequence
  spacer sequence
ccccgaucucgaucucaaga

SEQ ID NO: 9150 - RNA, 20 nt, Artificial Sequence
  spacer sequence
gcgucuaucccuggaccgag

SEQ ID NO: 9151 - RNA, 20 nt, Artificial Sequence
  spacer sequence
aucccuggaccgagaucgag

SEQ ID NO: 9152 - RNA, 20 nt, Artificial Sequence
  spacer sequence
cuggaccgagaucgagaacg

SEQ ID NO: 9153 - RNA, 20 nt, Artificial Sequence
  spacer sequence
agggauagacgccgacauuc

SEQ ID NO: 9154 - RNA, 20 nt, Artificial Sequence
  spacer sequence
guccagggauagacgccgac

SEQ ID NO: 9155 - RNA, 20 nt, Artificial Sequence
  spacer sequence
cgguccagggauagacgccg

SEQ ID NO: 9156 - RNA, 20 nt, Artificial Sequence
  spacer sequence
agaacgucgaugccgagacc

SEQ ID NO: 9157 - RNA, 20 nt, Artificial Sequence
  spacer sequence
aucucgguccagggauagac

SEQ ID NO: 9158 - RNA, 20 nt, Artificial Sequence
  spacer sequence
cgaucucgguccagggauag

SEQ ID NO: 9159 - RNA, 20 nt, Artificial Sequence
  spacer sequence
augccgagaccuucgagauc

SEQ ID NO: 9160 - RNA, 20 nt, Artificial Sequence
  spacer sequence
acguucucgaucucggucca

SEQ ID NO: 9161 - RNA, 20 nt, Artificial Sequence
  spacer sequence
gcaucgacguucucgaucuc

SEQ ID NO: 9162 - RNA, 20 nt, Artificial Sequence
  spacer sequence
cggcaucgacguucucgauc

SEQ ID NO: 9163 - RNA, 20 nt, Artificial Sequence
  spacer sequence
agaucuagaaccagaucuag

SEQ ID NO: 9164 - RNA, 20 nt, Artificial Sequence
  spacer sequence
aaggucucggcaucgacguu

SEQ ID NO: 9165 - RNA, 20 nt, Artificial Sequence
  spacer sequence
cgaaggucucggcaucgacg

SEQ ID NO: 9166 - RNA, 20 nt, Artificial Sequence
  spacer sequence
agaaccagaucuagaucgcc

SEQ ID NO: 9167 - RNA, 20 nt, Artificial Sequence
  spacer sequence
agaucucgaaggucucggca

SEQ ID NO: 9168 - RNA, 20 nt, Artificial Sequence
  spacer sequence
gguucuagaucucgaagguc

SEQ ID NO: 9169 - RNA, 20 nt, Artificial Sequence
  spacer sequence
agaucgccuccuuuuuggug

SEQ ID NO: 9170 - RNA, 20 nt, Artificial Sequence
  spacer sequence
agaucugguucuagaucucg

SEQ ID NO: 9171 - RNA, 20 nt, Artificial Sequence
  spacer sequence
ccuccuuuuuggugaccuaa

SEQ ID NO: 9172 - RNA, 20 nt, Artificial Sequence
  spacer sequence
uuuuuggugaccuaauguuu

SEQ ID NO: 9173 - RNA, 20 nt, Artificial Sequence
  spacer sequence
ccaaaaaggaggcgaucuag

SEQ ID NO: 9174 - RNA, 20 nt, Artificial Sequence
  spacer sequence
agagaagggagaaugcauag

SEQ ID NO: 9175 - RNA, 20 nt, Artificial Sequence
  spacer sequence
ugaaaacauuaggucaccaa

SEQ ID NO: 9176 - RNA, 20 nt, Artificial Sequence
  spacer sequence
cuugaaaacauuaggucacc

SEQ ID NO: 9177 - RNA, 20 nt, Artificial Sequence
  spacer sequence
cuucucuugaaaacauuagg

SEQ ID NO: 9178 - RNA, 20 nt, Artificial Sequence
  spacer sequence
cccuucucuugaaaacauua

SEQ ID NO: 9179 - RNA, 20 nt, Artificial Sequence
  spacer sequence
auaugcuaugcauucucccu

SEQ ID NO: 9180 - RNA, 20 nt, Artificial Sequence
  spacer sequence
auguccccuaagauauacag

SEQ ID NO: 9181 - RNA, 20 nt, Artificial Sequence
  spacer sequence
ccuaagauauacaggguugg

SEQ ID NO: 9182 - RNA, 20 nt, Artificial Sequence
  spacer sequence
uaggggacauagaaauuaaa

SEQ ID NO: 9183 - RNA, 20 nt, Artificial Sequence
  spacer sequence
aacccuguauaucuuagggg

SEQ ID NO: 9184 - RNA, 20 nt, Artificial Sequence
  spacer sequence
auaaauuaccuggaugcuga

SEQ ID NO: 9185 - RNA, 20 nt, Artificial Sequence
  spacer sequence
agguaauuuauagaaaaugu

SEQ ID NO: 9186 - RNA, 20 nt, Artificial Sequence
  spacer sequence
gcauccagguaauuuauaga

SEQ ID NO: 9187 - RNA, 20 nt, Artificial Sequence
  spacer sequence
aggucagcauccagguaauu

SEQ ID NO: 9188 - RNA, 20 nt, Artificial Sequence
  spacer sequence
ugacuuucuguuaucagaca

SEQ ID NO: 9189 - RNA, 20 nt, Artificial Sequence
  spacer sequence
agaucuaggucagcauccag

SEQ ID NO: 9190 - RNA, 20 nt, Artificial Sequence
  spacer sequence
guuaucagacauaugucgcu

SEQ ID NO: 9191 - RNA, 20 nt, Artificial Sequence
  spacer sequence
gacauaugucgcuuaaccuc

SEQ ID NO: 9192 - RNA, 20 nt, Artificial Sequence
  spacer sequence
gauaacagaaagucaagauc

SEQ ID NO: 9193 - RNA, 20 nt, Artificial Sequence
  spacer sequence
cuuaaccucuugaauacaag

SEQ ID NO: 9194 - RNA, 20 nt, Artificial Sequence
  spacer sequence
ugaauacaagguuguucuac

SEQ ID NO: 9195 - RNA, 20 nt, Artificial Sequence
  spacer sequence
agagguuaagcgacauaugu

SEQ ID NO: 9196 - RNA, 20 nt, Artificial Sequence
  spacer sequence
acuuccauuuccuuaaaaaa

SEQ ID NO: 9197 - RNA, 20 nt, Artificial Sequence
  spacer sequence
auuuccuuaaaaaacaaaaa

SEQ ID NO: 9198 - RNA, 20 nt, Artificial Sequence
  spacer sequence
uuaaaaaacaaaaaccauga

SEQ ID NO: 9199 - RNA, 20 nt, Artificial Sequence
  spacer sequence
ugguuuuuguuuuuuaagga

SEQ ID NO: 9200 - RNA, 20 nt, Artificial Sequence
  spacer sequence
uuuuaucaugguuuuuguuu

SEQ ID NO: 9201 - RNA, 20 nt, Artificial Sequence
  spacer sequence
cauuuuaucaugguuuuugu

SEQ ID NO: 9202 - RNA, 20 nt, Artificial Sequence
  spacer sequence
uuuuuuguugccuugacuua

SEQ ID NO: 9203 - RNA, 20 nt, Artificial Sequence
  spacer sequence
gagaauaaaguuuuaccugc

SEQ ID NO: 9204 - RNA, 20 nt, Artificial Sequence
  spacer sequence
gauaguuuuaucuuuuuuug

SEQ ID NO: 9205 - RNA, 20 nt, Artificial Sequence
  spacer sequence
cagauaguuuuaucuuuuuu

SEQ ID NO: 9206 - RNA, 20 nt, Artificial Sequence
  spacer sequence
gcagguaaaacuuuauucuc

SEQ ID NO: 9207 - RNA, 20 nt, Artificial Sequence
  spacer sequence
guguaagugguucauuuugu

SEQ ID NO: 9208 - RNA, 20 nt, Artificial Sequence
  spacer sequence
uuuugugccugaaaagaagc

SEQ ID NO: 9209 - RNA, 20 nt, Artificial Sequence
  spacer sequence
ggcacaaaaugaaccacuua

SEQ ID NO: 9210 - RNA, 20 nt, Artificial Sequence
  spacer sequence
uuucaggcacaaaaugaacc

SEQ ID NO: 9211 - RNA, 20 nt, Artificial Sequence
  spacer sequence
aagcuucuuuucaggcacaa

SEQ ID NO: 9212 - RNA, 20 nt, Artificial Sequence
  spacer sequence
accagugcagcagccuuucc

SEQ ID NO: 9213 - RNA, 20 nt, Artificial Sequence
  spacer sequence
aacuccaccagugcagcagc

SEQ ID NO: 9214 - RNA, 20 nt, Artificial Sequence
  spacer sequence
uccaacuccaccagugcagc

SEQ ID NO: 9215 - RNA, 20 nt, Artificial Sequence
  spacer sequence
caggcugagccaugggagga

SEQ ID NO: 9216 - RNA, 20 nt, Artificial Sequence
  spacer sequence
gccugugauuccuccaacuc

SEQ ID NO: 9217 - RNA, 20 nt, Artificial Sequence
  spacer sequence
cauggcucagccugugauuc

SEQ ID NO: 9218 - RNA, 20 nt, Artificial Sequence
  spacer sequence
ucccauggcucagccuguga

SEQ ID NO: 9219 - RNA, 20 nt, Artificial Sequence
  spacer sequence
auuuccucccauggcucagc

SEQ ID NO: 9220 - RNA, 20 nt, Artificial Sequence
  spacer sequence
uacaccuccauuuccuccca

SEQ ID NO: 9221 - RNA, 20 nt, Artificial Sequence
  spacer sequence
uccuacaccuccauuuccuc

SEQ ID NO: 9222 - RNA, 20 nt, Artificial Sequence
  spacer sequence
aaauccuggcauuuguccau

SEQ ID NO: 9223 - RNA, 20 nt, Artificial Sequence
  spacer sequence
uggcauuuguccauuaggag

SEQ ID NO: 9224 - RNA, 20 nt, Artificial Sequence
  spacer sequence
auuaggaggaaguggaaccu

SEQ ID NO: 9225 - RNA, 20 nt, Artificial Sequence
  spacer sequence
uaauggacaaaugccaggau

SEQ ID NO: 9226 - RNA, 20 nt, Artificial Sequence
  spacer sequence
uccuaauggacaaaugccag

SEQ ID NO: 9227 - RNA, 20 nt, Artificial Sequence
  spacer sequence
acuuccuccuaauggacaaa

SEQ ID NO: 9228 - RNA, 20 nt, Artificial Sequence
  spacer sequence
uuuuuaaagaaaguguauga

SEQ ID NO: 9229 - RNA, 20 nt, Artificial Sequence
  spacer sequence
uuaaaaaugaaagguuccac

SEQ ID NO: 9230 - RNA, 20 nt, Artificial Sequence
  spacer sequence
uacacuuucuuuaaaaauga

SEQ ID NO: 9231 - RNA, 20 nt, Artificial Sequence
  spacer sequence
aaauaauuuggaaaaccuuu

SEQ ID NO: 9232 - RNA, 20 nt, Artificial Sequence
  spacer sequence
aaauuauuuugauagcuauu

SEQ ID NO: 9233 - RNA, 20 nt, Artificial Sequence
  spacer sequence
ucaauaaaguuugaucaagg

SEQ ID NO: 9234 - RNA, 20 nt, Artificial Sequence
  spacer sequence
auaaaguuugaucaaggaaa

SEQ ID NO: 9235 - RNA, 20 nt, Artificial Sequence
  spacer sequence
aacuuuauugaggauauuuu

SEQ ID NO: 9236 - RNA, 20 nt, Artificial Sequence
  spacer sequence
aggaaaaguuacaacgacau

SEQ ID NO: 9237 - RNA, 20 nt, Artificial Sequence
  spacer sequence
uugaucaaacuuuauugagg

SEQ ID NO: 9238 - RNA, 20 nt, Artificial Sequence
  spacer sequence
uuguaacuuuuccuugauca

SEQ ID NO: 9239 - RNA, 20 nt, Artificial Sequence
  spacer sequence
acauuguuuaacaauuucca

SEQ ID NO: 9240 - RNA, 20 nt, Artificial Sequence
  spacer sequence
auauguacaauuuccacgca

SEQ ID NO: 9241 - RNA, 20 nt, Artificial Sequence
  spacer sequence
uuauuauuaugauacuuuau

SEQ ID NO: 9242 - RNA, 20 nt, Artificial Sequence
  spacer sequence
aacauauuucugcaugucag

SEQ ID NO: 9243 - RNA, 20 nt, Artificial Sequence
  spacer sequence
gcaugucaguuuaaacacaa

SEQ ID NO: 9244 - RNA, 20 nt, Artificial Sequence
  spacer sequence
guuuaaacacaaauaaaacu

SEQ ID NO: 9245 - RNA, 20 nt, Artificial Sequence
  spacer sequence
uauuuuaauaauaggcauuu

SEQ ID NO: 9246 - RNA, 20 nt, Artificial Sequence
  spacer sequence
caugcucauauuuuaauaau

SEQ ID NO: 9247 - RNA, 20 nt, Artificial Sequence
  spacer sequence
uuguuuuaauuacagaaaaa

SEQ ID NO: 9248 - RNA, 20 nt, Artificial Sequence
  spacer sequence
guaauuaaaacaaggaugcc

SEQ ID NO: 9249 - RNA, 20 nt, Artificial Sequence
  spacer sequence
aaauaguuacguguucaaca

SEQ ID NO: 9250 - RNA, 20 nt, Artificial Sequence
  spacer sequence
acagcuuuuaucagagauau

SEQ ID NO: 9251 - RNA, 20 nt, Artificial Sequence
  spacer sequence
auaaugaauagaucuuucuu

SEQ ID NO: 9252 - RNA, 20 nt, Artificial Sequence
  spacer sequence
uuauagagcguaugguuugc

SEQ ID NO: 9253 - RNA, 20 nt, Artificial Sequence
  spacer sequence
auucauuauagagcguaugg

SEQ ID NO: 9254 - RNA, 20 nt, Artificial Sequence
  spacer sequence
uucuuugaacugcaagaaaa

SEQ ID NO: 9255 - RNA, 20 nt, Artificial Sequence
  spacer sequence
uugaacugcaagaaaaaugc

SEQ ID NO: 9256 - RNA, 20 nt, Artificial Sequence
  spacer sequence
aagaaagaucuauucauuau

SEQ ID NO: 9257 - RNA, 20 nt, Artificial Sequence
  spacer sequence
ugcaguucaaagaaagaucu

SEQ ID NO: 9258 - RNA, 20 nt, Artificial Sequence
  spacer sequence
gguacaagcauuuuucuugc

SEQ ID NO: 9259 - RNA, 20 nt, Artificial Sequence
  spacer sequence
aaugcaccaucagguacaag

SEQ ID NO: 9260 - RNA, 20 nt, Artificial Sequence
  spacer sequence
uguuguauucccaucauucg

SEQ ID NO: 9261 - RNA, 20 nt, Artificial Sequence
  spacer sequence
caucauucguggcugaaacu

SEQ ID NO: 9262 - RNA, 20 nt, Artificial Sequence
  spacer sequence
uucguggcugaaacugaucc

SEQ ID NO: 9263 - RNA, 20 nt, Artificial Sequence
  spacer sequence
uggcugaaacugauccauau

SEQ ID NO: 9264 - RNA, 20 nt, Artificial Sequence
  spacer sequence
gccacgaaugaugggaauac

SEQ ID NO: 9265 - RNA, 20 nt, Artificial Sequence
  spacer sequence
guuucagccacgaaugaugg

SEQ ID NO: 9266 - RNA, 20 nt, Artificial Sequence
  spacer sequence
auauuuugaugcugugugua

SEQ ID NO: 9267 - RNA, 20 nt, Artificial Sequence
  spacer sequence
aaauauggaucaguuucagc

SEQ ID NO: 9268 - RNA, 20 nt, Artificial Sequence
  spacer sequence
ccaggaaagccacuaaaaaa

SEQ ID NO: 9269 - RNA, 20 nt, Artificial Sequence
  spacer sequence
aggaaagccacuaaaaaaag

SEQ ID NO: 9270 - RNA, 20 nt, Artificial Sequence
  spacer sequence
uggagauggcaugcagcagc

SEQ ID NO: 9271 - RNA, 20 nt, Artificial Sequence
  spacer sequence
accuuuuuuuaguggcuuuc

SEQ ID NO: 9272 - RNA, 20 nt, Artificial Sequence
  spacer sequence
uuuacccauucaaaagcaca

SEQ ID NO: 9273 - RNA, 20 nt, Artificial Sequence
  spacer sequence
aaagcacaagcuucucagcc

SEQ ID NO: 9274 - RNA, 20 nt, Artificial Sequence
  spacer sequence
guaaaauguuaaugacucau

SEQ ID NO: 9275 - RNA, 20 nt, Artificial Sequence
  spacer sequence
guauuauucccaacauaaaa

SEQ ID NO: 9276 - RNA, 20 nt, Artificial Sequence
  spacer sequence
caacauaaaagccauuuuuu

SEQ ID NO: 9277 - RNA, 20 nt, Artificial Sequence
  spacer sequence
ucauucaagagaaaacuaau

SEQ ID NO: 9278 - RNA, 20 nt, Artificial Sequence
  spacer sequence
uucaagagaaaacuaauacc

SEQ ID NO: 9279 - RNA, 20 nt, Artificial Sequence
  spacer sequence
agagaaaacuaauaccacaa

SEQ ID NO: 9280 - RNA, 20 nt, Artificial Sequence
  spacer sequence
ugaaugaggaagggauccuc

SEQ ID NO: 9281 - RNA, 20 nt, Artificial Sequence
  spacer sequence
cuugaaugaggaagggaucc

SEQ ID NO: 9282 - RNA, 20 nt, Artificial Sequence
  spacer sequence
uagaacauuguugucauugc

SEQ ID NO: 9283 - RNA, 20 nt, Artificial Sequence
  spacer sequence
augaaguuguuuuguaaaau

SEQ ID NO: 9284 - RNA, 20 nt, Artificial Sequence
  spacer sequence
uugcuaaauguuacuuaggu

SEQ ID NO: 9285 - RNA, 20 nt, Artificial Sequence
  spacer sequence
aucugcugaggaauaaaaaa

SEQ ID NO: 9286 - RNA, 20 nt, Artificial Sequence
  spacer sequence
gcugaggaauaaaaaaaaaa

SEQ ID NO: 9287 - RNA, 20 nt, Artificial Sequence
  spacer sequence
gcagauagaaaauugguaau

SEQ ID NO: 9288 - RNA, 20 nt, Artificial Sequence
  spacer sequence
ucagcagauagaaaauuggu

SEQ ID NO: 9289 - RNA, 20 nt, Artificial Sequence
  spacer sequence
acaggcaccauuguuaguuu

SEQ ID NO: 9290 - RNA, 20 nt, Artificial Sequence
  spacer sequence
uccacaggcaccauuguuag

SEQ ID NO: 9291 - RNA, 20 nt, Artificial Sequence
  spacer sequence
uccuccacaggcaccauugu

SEQ ID NO: 9292 - RNA, 20 nt, Artificial Sequence
  spacer sequence
uccuccuccacaggcaccau

SEQ ID NO: 9293 - RNA, 20 nt, Artificial Sequence
  spacer sequence
ccuccuccuccacaggcacc

SEQ ID NO: 9294 - RNA, 20 nt, Artificial Sequence
  spacer sequence
uggugacggcagugguaucc

SEQ ID NO: 9295 - RNA, 20 nt, Artificial Sequence
  spacer sequence
ccacgacagcaccugcugcc

SEQ ID NO: 9296 - RNA, 20 nt, Artificial Sequence
  spacer sequence
ucuuucuuugauucuuccac

SEQ ID NO: 9297 - RNA, 20 nt, Artificial Sequence
  spacer sequence
uucuuugauucuuccacagc

SEQ ID NO: 9298 - RNA, 20 nt, Artificial Sequence
  spacer sequence
uugauucuuccacagcuucu

SEQ ID NO: 9299 - RNA, 20 nt, Artificial Sequence
  spacer sequence
aagaaagaggauaccacugc

SEQ ID NO: 9300 - RNA, 20 nt, Artificial Sequence
  spacer sequence
uccacagcuucuggcucauc

SEQ ID NO: 9301 - RNA, 20 nt, Artificial Sequence
  spacer sequence
acagcuucuggcucaucauc

SEQ ID NO: 9302 - RNA, 20 nt, Artificial Sequence
  spacer sequence
ggcucaucaucauagucaaa

SEQ ID NO: 9303 - RNA, 20 nt, Artificial Sequence
  spacer sequence
ucaucauagucaaaucuauc

SEQ ID NO: 9304 - RNA, 20 nt, Artificial Sequence
  spacer sequence
ucauagucaaaucuaucaag

SEQ ID NO: 9305 - RNA, 20 nt, Artificial Sequence
  spacer sequence
uagucaaaucuaucaagcaa

SEQ ID NO: 9306 - RNA, 20 nt, Artificial Sequence
  spacer sequence
aaucuaucaagcaacuucug

SEQ ID NO: 9307 - RNA, 20 nt, Artificial Sequence
  spacer sequence
aucaagcaacuucuggaaua

SEQ ID NO: 9308 - RNA, 20 nt, Artificial Sequence
  spacer sequence
agcaacuucuggaauaauua

SEQ ID NO: 9309 - RNA, 20 nt, Artificial Sequence
  spacer sequence
ggaauaauuaugucaauauu

SEQ ID NO: 9310 - RNA, 20 nt, Artificial Sequence
  spacer sequence
agaaguugcuugauagauuu

SEQ ID NO: 9311 - RNA, 20 nt, Artificial Sequence
  spacer sequence
auauuucauuuuaaaauuua

SEQ ID NO: 9312 - RNA, 20 nt, Artificial Sequence
  spacer sequence
uuuuaaaauuuagacugauu

SEQ ID NO: 9313 - RNA, 20 nt, Artificial Sequence
  spacer sequence
aaauuuuaaaaugaaauauu

SEQ ID NO: 9314 - RNA, 20 nt, Artificial Sequence
  spacer sequence
gucuaaauuuuaaaaugaaa

SEQ ID NO: 9315 - RNA, 20 nt, Artificial Sequence
  spacer sequence
cugcacaaaaaacuuuauga

SEQ ID NO: 9316 - RNA, 20 nt, Artificial Sequence
  spacer sequence
uaaaguuuuuugugcaguga

SEQ ID NO: 9317 - RNA, 20 nt, Artificial Sequence
  spacer sequence
uuuuguacauuuuaugcuga

SEQ ID NO: 9318 - RNA, 20 nt, Artificial Sequence
  spacer sequence
uauucaaucaccauaaugca

SEQ ID NO: 9319 - RNA, 20 nt, Artificial Sequence
  spacer sequence
aucaccauaaugcauauaga

SEQ ID NO: 9320 - RNA, 20 nt, Artificial Sequence
  spacer sequence
ccauaaugcauauagaaaag

SEQ ID NO: 9321 - RNA, 20 nt, Artificial Sequence
  spacer sequence
auaugcauuauggugauuga

SEQ ID NO: 9322 - RNA, 20 nt, Artificial Sequence
  spacer sequence
auauacugcuuccucaagaa

SEQ ID NO: 9323 - RNA, 20 nt, Artificial Sequence
  spacer sequence
ucaagaauauacuaauauaa

SEQ ID NO: 9324 - RNA, 20 nt, Artificial Sequence
  spacer sequence
agaauauacuaauauaaaaa

SEQ ID NO: 9325 - RNA, 20 nt, Artificial Sequence
  spacer sequence
ugaggaagcaguauauggac

SEQ ID NO: 9326 - RNA, 20 nt, Artificial Sequence
  spacer sequence
uuaaaguuugaagaauacug

SEQ ID NO: 9327 - RNA, 20 nt, Artificial Sequence
  spacer sequence
aacuuuaaagaacauauuaa

SEQ ID NO: 9328 - RNA, 20 nt, Artificial Sequence
  spacer sequence
ucaaacuuuaaagaacauau

SEQ ID NO: 9329 - RNA, 20 nt, Artificial Sequence
  spacer sequence
acccaaaaagaaauuuuagu

SEQ ID NO: 9330 - RNA, 20 nt, Artificial Sequence
  spacer sequence
uuuuggguagaccccauuuu

SEQ ID NO: 9331 - RNA, 20 nt, Artificial Sequence
  spacer sequence
cuacuuuuuuauacacuaaa

SEQ ID NO: 9332 - RNA, 20 nt, Artificial Sequence
  spacer sequence
cucacuacuuuuuuauacac

SEQ ID NO: 9333 - RNA, 20 nt, Artificial Sequence
  spacer sequence
cccucacuacuuuuuuauac

SEQ ID NO: 9334 - RNA, 20 nt, Artificial Sequence
  spacer sequence
aaaacauaaugguuuaacua

SEQ ID NO: 9335 - RNA, 20 nt, Artificial Sequence
  spacer sequence
ucaaccauauucuaaaacag

SEQ ID NO: 9336 - RNA, 20 nt, Artificial Sequence
  spacer sequence
accauauucuaaaacagauu

SEQ ID NO: 9337 - RNA, 20 nt, Artificial Sequence
  spacer sequence
aaaacagauuccagagggac

SEQ ID NO: 9338 - RNA, 20 nt, Artificial Sequence
  spacer sequence
gucaucacucauaaaucacu

SEQ ID NO: 9339 - RNA, 20 nt, Artificial Sequence
  spacer sequence
ucacucauaaaucacuaaga

SEQ ID NO: 9340 - RNA, 20 nt, Artificial Sequence
  spacer sequence
cucauaaaucacuaagauau

SEQ ID NO: 9341 - RNA, 20 nt, Artificial Sequence
  spacer sequence
uaaaucacuaagauauaaug

SEQ ID NO: 9342 - RNA, 20 nt, Artificial Sequence
  spacer sequence
cuaagauauaaugaaaacug

SEQ ID NO: 9343 - RNA, 20 nt, Artificial Sequence
  spacer sequence
uagugauuuaugagugauga

SEQ ID NO: 9344 - RNA, 20 nt, Artificial Sequence
  spacer sequence
uuauaucuuagugauuuaug

SEQ ID NO: 9345 - RNA, 20 nt, Artificial Sequence
  spacer sequence
accuaguaaauaccaguuuu

SEQ ID NO: 9346 - RNA, 20 nt, Artificial Sequence
  spacer sequence
aaauuaaaaauccaccuagu

SEQ ID NO: 9347 - RNA, 20 nt, Artificial Sequence
  spacer sequence
uaacuauaaaaacagaagga

SEQ ID NO: 9348 - RNA, 20 nt, Artificial Sequence
  spacer sequence
aacauccuaacuauaaaaac

SEQ ID NO: 9349 - RNA, 20 nt, Artificial Sequence
  spacer sequence
uuccaacauccuaacuauaa

SEQ ID NO: 9350 - RNA, 20 nt, Artificial Sequence
  spacer sequence
gauauuuuaaagaugaugaa

SEQ ID NO: 9351 - RNA, 20 nt, Artificial Sequence
  spacer sequence
gauucuuuccaacauccuaa

SEQ ID NO: 9352 - RNA, 20 nt, Artificial Sequence
  spacer sequence
uuaaaauaucugauucuuuc

SEQ ID NO: 9353 - RNA, 20 nt, Artificial Sequence
  spacer sequence
ucuuuaaaauaucugauucu

SEQ ID NO: 9354 - RNA, 20 nt, Artificial Sequence
  spacer sequence
ucaucuuuaaaauaucugau

SEQ ID NO: 9355 - RNA, 20 nt, Artificial Sequence
  spacer sequence
guucugauuuucaaacuuuu

SEQ ID NO: 9356 - RNA, 20 nt, Artificial Sequence
  spacer sequence
gauuuucaaacuuuugaguu

SEQ ID NO: 9357 - RNA, 20 nt, Artificial Sequence
  spacer sequence
gaacugaugccuuugguuuc

SEQ ID NO: 9358 - RNA, 20 nt, Artificial Sequence
  spacer sequence
aacuuuugaguuuuuuugca

SEQ ID NO: 9359 - RNA, 20 nt, Artificial Sequence
  spacer sequence
ucuuuuuuguuguugcuugu

SEQ ID NO: 9360 - RNA, 20 nt, Artificial Sequence
  spacer sequence
uuuuuguuguugcuuguuuu

SEQ ID NO: 9361 - RNA, 20 nt, Artificial Sequence
  spacer sequence
aaaaaacaagcaacaacaaa

SEQ ID NO: 9362 - RNA, 20 nt, Artificial Sequence
  spacer sequence
cuaaaaaacaagcaacaaca

SEQ ID NO: 9363 - RNA, 20 nt, Artificial Sequence
  spacer sequence
ugucucuaaaaaacaagcaa

SEQ ID NO: 9364 - RNA, 20 nt, Artificial Sequence
  spacer sequence
cauucuguugcccaggcuag

SEQ ID NO: 9365 - RNA, 20 nt, Artificial Sequence
  spacer sequence
uucuguugcccaggcuagug

SEQ ID NO: 9366 - RNA, 20 nt, Artificial Sequence
  spacer sequence
guugcccaggcuaguggcac

SEQ ID NO: 9367 - RNA, 20 nt, Artificial Sequence
  spacer sequence
uggcuuacugcagcuuugaa

SEQ ID NO: 9368 - RNA, 20 nt, Artificial Sequence
  spacer sequence
aagcugcaguaagccaugau

SEQ ID NO: 9369 - RNA, 20 nt, Artificial Sequence
  spacer sequence
uggggccaagcaacccaccc

SEQ ID NO: 9370 - RNA, 20 nt, Artificial Sequence
  spacer sequence
gcauccuggguagcuagggc

SEQ ID NO: 9371 - RNA, 20 nt, Artificial Sequence
  spacer sequence
uggguagcuagggcuacagg

SEQ ID NO: 9372 - RNA, 20 nt, Artificial Sequence
  spacer sequence
auuaaagaaaagcauguauc

SEQ ID NO: 9373 - RNA, 20 nt, Artificial Sequence
  spacer sequence
uuaauugaguauaauacaua

SEQ ID NO: 9374 - RNA, 20 nt, Artificial Sequence
  spacer sequence
guaggaaauuaauucugaaa

SEQ ID NO: 9375 - RNA, 20 nt, Artificial Sequence
  spacer sequence
uacagauacaugcuuuucuu

SEQ ID NO: 9376 - RNA, 20 nt, Artificial Sequence
  spacer sequence
gaaaagauguaaggcaaaau

SEQ ID NO: 9377 - RNA, 20 nt, Artificial Sequence
  spacer sequence
gaauuaauuuccuacagaua

SEQ ID NO: 9378 - RNA, 20 nt, Artificial Sequence
  spacer sequence
uuucagaauuaauuuccuac

SEQ ID NO: 9379 - RNA, 20 nt, Artificial Sequence
  spacer sequence
uuuuuuuuuuuuuuucacuu

SEQ ID NO: 9380 - RNA, 20 nt, Artificial Sequence
  spacer sequence
cuuuuuuaauuuuacacuag

SEQ ID NO: 9381 - RNA, 20 nt, Artificial Sequence
  spacer sequence
gcuucaaacccuggaaauuu

SEQ ID NO: 9382 - RNA, 20 nt, Artificial Sequence
  spacer sequence
aacccuggaaauuuuugcac

SEQ ID NO: 9383 - RNA, 20 nt, Artificial Sequence
  spacer sequence
aggguuugaagcugaauuua

SEQ ID NO: 9384 - RNA, 20 nt, Artificial Sequence
  spacer sequence
gugcaaaaauuuccaggguu

SEQ ID NO: 9385 - RNA, 20 nt, Artificial Sequence
  spacer sequence
cauuuaaaaccagggaaaau

SEQ ID NO: 9386 - RNA, 20 nt, Artificial Sequence
  spacer sequence
cugguuuuaaaugugauaug

SEQ ID NO: 9387 - RNA, 20 nt, Artificial Sequence
  spacer sequence
auguuuucuuguugaggggg

SEQ ID NO: 9388 - RNA, 20 nt, Artificial Sequence
  spacer sequence
auuauuuucccugguuuuaa

SEQ ID NO: 9389 - RNA, 20 nt, Artificial Sequence
  spacer sequence
uguugagggggaaaaucucu

SEQ ID NO: 9390 - RNA, 20 nt, Artificial Sequence
  spacer sequence
acaagaaaacaucgauuauu

SEQ ID NO: 9391 - RNA, 20 nt, Artificial Sequence
  spacer sequence
cccucaacaagaaaacaucg

SEQ ID NO: 9392 - RNA, 20 nt, Artificial Sequence
  spacer sequence
cucaaauuacaaaacgacau

SEQ ID NO: 9393 - RNA, 20 nt, Artificial Sequence
  spacer sequence
caaauuacaaaacgacauaa

SEQ ID NO: 9394 - RNA, 20 nt, Artificial Sequence
  spacer sequence
auaacucaaguugagugaua

SEQ ID NO: 9395 - RNA, 20 nt, Artificial Sequence
  spacer sequence
aguugagugauauaaauggu

SEQ ID NO: 9396 - RNA, 20 nt, Artificial Sequence
  spacer sequence
acuugaguuauggaaauuau

SEQ ID NO: 9397 - RNA, 20 nt, Artificial Sequence
  spacer sequence
cucaacuugaguuauggaaa

SEQ ID NO: 9398 - RNA, 20 nt, Artificial Sequence
  spacer sequence
cauaacccaccccaccauuu

SEQ ID NO: 9399 - RNA, 20 nt, Artificial Sequence
  spacer sequence
cacauaacccaccccaccau

SEQ ID NO: 9400 - RNA, 20 nt, Artificial Sequence
  spacer sequence
cucacauaacccaccccacc

SEQ ID NO: 9401 - RNA, 20 nt, Artificial Sequence
  spacer sequence
aaugcaguuuucuguucagg

SEQ ID NO: 9402 - RNA, 20 nt, Artificial Sequence
  spacer sequence
guucagguggggggaaagca

SEQ ID NO: 9403 - RNA, 20 nt, Artificial Sequence
  spacer sequence
gguggggggaaagcagcuuu

SEQ ID NO: 9404 - RNA, 20 nt, Artificial Sequence
  spacer sequence
ccccaccugaacagaaaacu

SEQ ID NO: 9405 - RNA, 20 nt, Artificial Sequence
  spacer sequence
gaugguuguguaggaguugu

SEQ ID NO: 9406 - RNA, 20 nt, Artificial Sequence
  spacer sequence
gaacaaaaagcugcuuuccc

SEQ ID NO: 9407 - RNA, 20 nt, Artificial Sequence
  spacer sequence
uacacaaccaucugaacaaa

SEQ ID NO: 9408 - RNA, 20 nt, Artificial Sequence
  spacer sequence
uuaacugagcugugauagcc

SEQ ID NO: 9409 - RNA, 20 nt, Artificial Sequence
  spacer sequence
guuaaagacaacuccuacac

SEQ ID NO: 9410 - RNA, 20 nt, Artificial Sequence
  spacer sequence
cagcucaguuaaagacaacu

SEQ ID NO: 9411 - RNA, 20 nt, Artificial Sequence
  spacer sequence
ggcuaucacagcucaguuaa

SEQ ID NO: 9412 - RNA, 20 nt, Artificial Sequence
  spacer sequence
gguucaggcuaucacagcuc

SEQ ID NO: 9413 - RNA, 20 nt, Artificial Sequence
  spacer sequence
cagcauugucaagggcagga

SEQ ID NO: 9414 - RNA, 20 nt, Artificial Sequence
  spacer sequence
agggcaggagacugugguuu

SEQ ID NO: 9415 - RNA, 20 nt, Artificial Sequence
  spacer sequence
ugcccuugacaaugcuguga

SEQ ID NO: 9416 - RNA, 20 nt, Artificial Sequence
  spacer sequence
ccugcccuugacaaugcugu

SEQ ID NO: 9417 - RNA, 20 nt, Artificial Sequence
  spacer sequence
aaaaccacagucuccugccc

SEQ ID NO: 9418 - RNA, 20 nt, Artificial Sequence
  spacer sequence
acagccuccaaaaccacagu

SEQ ID NO: 9419 - RNA, 20 nt, Artificial Sequence
  spacer sequence
gaaggaucugcugaagcuua

SEQ ID NO: 9420 - RNA, 20 nt, Artificial Sequence
  spacer sequence
gacuuuucaacagccuccaa

SEQ ID NO: 9421 - RNA, 20 nt, Artificial Sequence
  spacer sequence
uucagacuuuucaacagccu

SEQ ID NO: 9422 - RNA, 20 nt, Artificial Sequence
  spacer sequence
gcugaagcuuaaagaauggg

SEQ ID NO: 9423 - RNA, 20 nt, Artificial Sequence
  spacer sequence
gcagauccuucagacuuuuc

SEQ ID NO: 9424 - RNA, 20 nt, Artificial Sequence
  spacer sequence
uuaagcuucagcagauccuu

SEQ ID NO: 9425 - RNA, 20 nt, Artificial Sequence
  spacer sequence
cauucuuuaagcuucagcag

SEQ ID NO: 9426 - RNA, 20 nt, Artificial Sequence
  spacer sequence
cagaacaaaguauaaucaua

SEQ ID NO: 9427 - RNA, 20 nt, Artificial Sequence
  spacer sequence
gugauuuauugguuuuccca

SEQ ID NO: 9428 - RNA, 20 nt, Artificial Sequence
  spacer sequence
uacuaucaaaaguuaauuua

SEQ ID NO: 9429 - RNA, 20 nt, Artificial Sequence
  spacer sequence
aaaguuaauuuaauaaaaaa

SEQ ID NO: 9430 - RNA, 20 nt, Artificial Sequence
  spacer sequence
uaaaggugauucaaaguagc

SEQ ID NO: 9431 - RNA, 20 nt, Artificial Sequence
  spacer sequence
ccuuuaagacauuuuuuuau

SEQ ID NO: 9432 - RNA, 20 nt, Artificial Sequence
  spacer sequence
aaguagcauaggcacagaac

SEQ ID NO: 9433 - RNA, 20 nt, Artificial Sequence
  spacer sequence
gugccuaugcuacuuugaau

SEQ ID NO: 9434 - RNA, 20 nt, Artificial Sequence
  spacer sequence
ccaauuuguucugugccuau

SEQ ID NO: 9435 - RNA, 20 nt, Artificial Sequence
  spacer sequence
uuuuaugaaugguuaaauuu

SEQ ID NO: 9436 - RNA, 20 nt, Artificial Sequence
  spacer sequence
uaaaaggauuuuuuccccaa

SEQ ID NO: 9437 - RNA, 20 nt, Artificial Sequence
  spacer sequence
gcauacauuuuuaaccuuaa

SEQ ID NO: 9438 - RNA, 20 nt, Artificial Sequence
  spacer sequence
augauaugauggucaaaaaa

SEQ ID NO: 9439 - RNA, 20 nt, Artificial Sequence
  spacer sequence
uugacauugucagcauacau

SEQ ID NO: 9440 - RNA, 20 nt, Artificial Sequence
  spacer sequence
uaucauugacauugucagca

SEQ ID NO: 9441 - RNA, 20 nt, Artificial Sequence
  spacer sequence
aaaaaagagaaaauacacug

SEQ ID NO: 9442 - RNA, 20 nt, Artificial Sequence
  spacer sequence
uuuuuugaccaucauaucau

SEQ ID NO: 9443 - RNA, 20 nt, Artificial Sequence
  spacer sequence
cuuuuuuugaccaucauauc

SEQ ID NO: 9444 - RNA, 20 nt, Artificial Sequence
  spacer sequence
guguauuuucucuuuuuuug

SEQ ID NO: 9445 - RNA, 20 nt, Artificial Sequence
  spacer sequence
caauucaguguauuuucucu

SEQ ID NO: 9446 - RNA, 20 nt, Artificial Sequence
  spacer sequence
ugcaaacaauuucacuuuug

SEQ ID NO: 9447 - RNA, 20 nt, Artificial Sequence
  spacer sequence
cuuuugaguagacaguuuac

SEQ ID NO: 9448 - RNA, 20 nt, Artificial Sequence
  spacer sequence
aaagugaaauuguuugcagg

SEQ ID NO: 9449 - RNA, 20 nt, Artificial Sequence
  spacer sequence
acucaaaagugaaauuguuu

SEQ ID NO: 9450 - RNA, 20 nt, Artificial Sequence
  spacer sequence
aggccaacagguaaacuguc

SEQ ID NO: 9451 - RNA, 20 nt, Artificial Sequence
  spacer sequence
gaaacagcugagccacagca

SEQ ID NO: 9452 - RNA, 20 nt, Artificial Sequence
  spacer sequence
gacaacucaaggccaacagg

SEQ ID NO: 9453 - RNA, 20 nt, Artificial Sequence
  spacer sequence
gcuguuucagacaacucaag

SEQ ID NO: 9454 - RNA, 20 nt, Artificial Sequence
  spacer sequence
gagcugggcaacugugguac

SEQ ID NO: 9455 - RNA, 20 nt, Artificial Sequence
  spacer sequence
gaugcuuuugcugcuguggc

SEQ ID NO: 9456 - RNA, 20 nt, Artificial Sequence
  spacer sequence
cagcuguaccacaguugccc

SEQ ID NO: 9457 - RNA, 20 nt, Artificial Sequence
  spacer sequence
gucccagcuguaccacaguu

SEQ ID NO: 9458 - RNA, 20 nt, Artificial Sequence
  spacer sequence
aaacuccgucccagcuguac

SEQ ID NO: 9459 - RNA, 20 nt, Artificial Sequence
  spacer sequence
cacacaagccacuccaaacu

SEQ ID NO: 9460 - RNA, 20 nt, Artificial Sequence
  spacer sequence
gaagaaacuuuuacuggagg

SEQ ID NO: 9461 - RNA, 20 nt, Artificial Sequence
  spacer sequence
gaaccucccacacaagccac

SEQ ID NO: 9462 - RNA, 20 nt, Artificial Sequence
  spacer sequence
ucugaaccucccacacaagc

SEQ ID NO: 9463 - RNA, 20 nt, Artificial Sequence
  spacer sequence
aguaaaaguuucuucugaac

SEQ ID NO: 9464 - RNA, 20 nt, Artificial Sequence
  spacer sequence
accuccaguaaaaguuucuu

SEQ ID NO: 9465 - RNA, 20 nt, Artificial Sequence
  spacer sequence
ccuccaccuccaguaaaagu

SEQ ID NO: 9466 - RNA, 20 nt, Artificial Sequence
  spacer sequence
uuuuuaggcucaccuccacc

SEQ ID NO: 9467 - RNA, 20 nt, Artificial Sequence
  spacer sequence
cacaaugguaugauuuuuug

SEQ ID NO: 9468 - RNA, 20 nt, Artificial Sequence
  spacer sequence
cagauacaucugaccauacc

SEQ ID NO: 9469 - RNA, 20 nt, Artificial Sequence
  spacer sequence
gugagcucacacaaugguau

SEQ ID NO: 9470 - RNA, 20 nt, Artificial Sequence
  spacer sequence
gaccauaccuucauuauugg

SEQ ID NO: 9471 - RNA, 20 nt, Artificial Sequence
  spacer sequence
gauguaucugugagcucaca

SEQ ID NO: 9472 - RNA, 20 nt, Artificial Sequence
  spacer sequence
uuauugguaacauuuucugc

SEQ ID NO: 9473 - RNA, 20 nt, Artificial Sequence
  spacer sequence
gcuacuggggcugcauuacu

SEQ ID NO: 9474 - RNA, 20 nt, Artificial Sequence
  spacer sequence
cgcugccauguccaaaagag

SEQ ID NO: 9475 - RNA, 20 nt, Artificial Sequence
  spacer sequence
aaaagagguugaauaauuuc

SEQ ID NO: 9476 - RNA, 20 nt, Artificial Sequence
  spacer sequence
uuuggacauggcagcgggaa

SEQ ID NO: 9477 - RNA, 20 nt, Artificial Sequence
  spacer sequence
accucuuuuggacauggcag

SEQ ID NO: 9478 - RNA, 20 nt, Artificial Sequence
  spacer sequence
auuuugaacacuccauuuuu

SEQ ID NO: 9479 - RNA, 20 nt, Artificial Sequence
  spacer sequence
aaauugaaauuauucaaccu

SEQ ID NO: 9480 - RNA, 20 nt, Artificial Sequence
  spacer sequence
auuuuuuugccaaagguuca

SEQ ID NO: 9481 - RNA, 20 nt, Artificial Sequence
  spacer sequence
gcacacgaacuauuuuacuc

SEQ ID NO: 9482 - RNA, 20 nt, Artificial Sequence
  spacer sequence
ugugcugaaccuuuggcaaa

SEQ ID NO: 9483 - RNA, 20 nt, Artificial Sequence
  spacer sequence
guuacgcaugagaaacacaa

SEQ ID NO: 9484 - RNA, 20 nt, Artificial Sequence
  spacer sequence
ugcguaacagaguaaaauag

SEQ ID NO: 9485 - RNA, 20 nt, Artificial Sequence
  spacer sequence
caugcguaacagaguaaaau

SEQ ID NO: 9486 - RNA, 20 nt, Artificial Sequence
  spacer sequence
guuauuuaugcaaauauuua

SEQ ID NO: 9487 - RNA, 20 nt, Artificial Sequence
  spacer sequence
uaugaguucuucaggauuau

SEQ ID NO: 9488 - RNA, 20 nt, Artificial Sequence
  spacer sequence
uguuuauuuucuuaugaguu

SEQ ID NO: 9489 - RNA, 20 nt, Artificial Sequence
  spacer sequence
uuucguguuuauuuucuuau

SEQ ID NO: 9490 - RNA, 20 nt, Artificial Sequence
  spacer sequence
guggucauuucguguuuauu

SEQ ID NO: 9491 - RNA, 20 nt, Artificial Sequence
  spacer sequence
ucaguggucauuucguguuu

SEQ ID NO: 9492 - RNA, 20 nt, Artificial Sequence
  spacer sequence
agcucacagacaucgcuaca

SEQ ID NO: 9493 - RNA, 20 nt, Artificial Sequence
  spacer sequence
cagacaucgcuacaugaaaa

SEQ ID NO: 9494 - RNA, 20 nt, Artificial Sequence
  spacer sequence
gugagcuugaaacaaaacag

SEQ ID NO: 9495 - RNA, 20 nt, Artificial Sequence
  spacer sequence
cuacaugaaaaucuuaucug

SEQ ID NO: 9496 - RNA, 20 nt, Artificial Sequence
  spacer sequence
uguagcgaugucugugagcu

SEQ ID NO: 9497 - RNA, 20 nt, Artificial Sequence
  spacer sequence
uaucugguaauauaguaggc

SEQ ID NO: 9498 - RNA, 20 nt, Artificial Sequence
  spacer sequence
uuaaaaaauauuauuuuaaa

SEQ ID NO: 9499 - RNA, 20 nt, Artificial Sequence
  spacer sequence
ucagauggacaaagauauaa

SEQ ID NO: 9500 - RNA, 20 nt, Artificial Sequence
  spacer sequence
gauggacaaagauauaaaua

SEQ ID NO: 9501 - RNA, 20 nt, Artificial Sequence
  spacer sequence
gaagauaagguauaauuaau

SEQ ID NO: 9502 - RNA, 20 nt, Artificial Sequence
  spacer sequence
aucugaagauaagguauaau

SEQ ID NO: 9503 - RNA, 20 nt, Artificial Sequence
  spacer sequence
uuguccaucugaagauaagg

SEQ ID NO: 9504 - RNA, 20 nt, Artificial Sequence
  spacer sequence
aauauuuauaucuuugucca

SEQ ID NO: 9505 - RNA, 20 nt, Artificial Sequence
  spacer sequence
aaaaacauaacugccacauu

SEQ ID NO: 9506 - RNA, 20 nt, Artificial Sequence
  spacer sequence
cuaaaaacauaacugccaca

SEQ ID NO: 9507 - RNA, 20 nt, Artificial Sequence
  spacer sequence
uggcccaaaaacaucuuuau

SEQ ID NO: 9508 - RNA, 20 nt, Artificial Sequence
  spacer sequence
uuaucaguuccaaacugaug

SEQ ID NO: 9509 - RNA, 20 nt, Artificial Sequence
  spacer sequence
guuccaaacugaugacgaga

SEQ ID NO: 9510 - RNA, 20 nt, Artificial Sequence
  spacer sequence
aaacugaugacgagacuguc

SEQ ID NO: 9511 - RNA, 20 nt, Artificial Sequence
  spacer sequence
guuuggaacugauaaagaug

SEQ ID NO: 9512 - RNA, 20 nt, Artificial Sequence
  spacer sequence
ucaguuuggaacugauaaag

SEQ ID NO: 9513 - RNA, 20 nt, Artificial Sequence
  spacer sequence
ucaucaguuuggaacugaua

SEQ ID NO: 9514 - RNA, 20 nt, Artificial Sequence
  spacer sequence
cgucaucaguuuggaacuga

SEQ ID NO: 9515 - RNA, 20 nt, Artificial Sequence
  spacer sequence
cacaauugagucaauuacau

SEQ ID NO: 9516 - RNA, 20 nt, Artificial Sequence
  spacer sequence
auugugcgacagucucguca

SEQ ID NO: 9517 - RNA, 20 nt, Artificial Sequence
  spacer sequence
auuacauauaaucccggaac

SEQ ID NO: 9518 - RNA, 20 nt, Artificial Sequence
  spacer sequence
cggaaccuuguauucugguu

SEQ ID NO: 9519 - RNA, 20 nt, Artificial Sequence
  spacer sequence
gggauuauauguaauugacu

SEQ ID NO: 9520 - RNA, 20 nt, Artificial Sequence
  spacer sequence
gguuuacacugcaaggauaa

SEQ ID NO: 9521 - RNA, 20 nt, Artificial Sequence
  spacer sequence
uugcaguguaaaccagaaua

SEQ ID NO: 9522 - RNA, 20 nt, Artificial Sequence
  spacer sequence
uuauccuugcaguguaaacc

SEQ ID NO: 9523 - RNA, 20 nt, Artificial Sequence
  spacer sequence
uacaucuuuauccuugcagu

SEQ ID NO: 9524 - RNA, 20 nt, Artificial Sequence
  spacer sequence
guacagaaaaagcaaaguca

SEQ ID NO: 9525 - RNA, 20 nt, Artificial Sequence
  spacer sequence
guacugaucuuacaucuuua

SEQ ID NO: 9526 - RNA, 20 nt, Artificial Sequence
  spacer sequence
acuaccaccagaaauauaua

SEQ ID NO: 9527 - RNA, 20 nt, Artificial Sequence
  spacer sequence
auaaaggguuauaccuguuu

SEQ ID NO: 9528 - RNA, 20 nt, Artificial Sequence
  spacer sequence
ucuauaaaggguuauaccug

SEQ ID NO: 9529 - RNA, 20 nt, Artificial Sequence
  spacer sequence
uauuuaauccaccaauucua

SEQ ID NO: 9530 - RNA, 20 nt, Artificial Sequence
  spacer sequence
accaauucuacaucuaggaa

SEQ ID NO: 9531 - RNA, 20 nt, Artificial Sequence
  spacer sequence
acaucuaggaauuuaugcaa

SEQ ID NO: 9532 - RNA, 20 nt, Artificial Sequence
  spacer sequence
guuguuuuauaacuguguga

SEQ ID NO: 9533 - RNA, 20 nt, Artificial Sequence
  spacer sequence
gcugucuguuguuuuauaac

SEQ ID NO: 9534 - RNA, 20 nt, Artificial Sequence
  spacer sequence
guucagcugucuguuguuuu

SEQ ID NO: 9535 - RNA, 20 nt, Artificial Sequence
  spacer sequence
gaugggaaaagggaaaaauu

SEQ ID NO: 9536 - RNA, 20 nt, Artificial Sequence
  spacer sequence
gaauaaaauuauuuucaguu

SEQ ID NO: 9537 - RNA, 20 nt, Artificial Sequence
  spacer sequence
caucagaauaaaauuauuuu

SEQ ID NO: 9538 - RNA, 20 nt, Artificial Sequence
  spacer sequence
cuuuucccaucagaauaaaa

SEQ ID NO: 9539 - RNA, 20 nt, Artificial Sequence
  spacer sequence
caauuuuucccuuuucccau

SEQ ID NO: 9540 - RNA, 20 nt, Artificial Sequence
  spacer sequence
aauuuucccaauuuuucccu

SEQ ID NO: 9541 - RNA, 20 nt, Artificial Sequence
  spacer sequence
uuuuaaucacuagaaguuua

SEQ ID NO: 9542 - RNA, 20 nt, Artificial Sequence
  spacer sequence
agugacuaaauuuuuaugaa

SEQ ID NO: 9543 - RNA, 20 nt, Artificial Sequence
  spacer sequence
cuagagguucuuuuuaauca

SEQ ID NO: 9544 - RNA, 20 nt, Artificial Sequence
  spacer sequence
uaaaaauuuagucacuagag

SEQ ID NO: 9545 - RNA, 20 nt, Artificial Sequence
  spacer sequence
aaaccacuucauaaaaauuu

SEQ ID NO: 9546 - RNA, 20 nt, Artificial Sequence
  spacer sequence
augcuuguuucuaaaccacu

SEQ ID NO: 9547 - RNA, 20 nt, Artificial Sequence
  spacer sequence
caaugcuuguuucuaaacca

SEQ ID NO: 9548 - RNA, 20 nt, Artificial Sequence
  spacer sequence
uuuuaguuacaauaugauuu

SEQ ID NO: 9549 - RNA, 20 nt, Artificial Sequence
  spacer sequence
uuauaaccucauuuuaguua

SEQ ID NO: 9550 - RNA, 20 nt, Artificial Sequence
  spacer sequence
cauuauaaccucauuuuagu

SEQ ID NO: 9551 - RNA, 20 nt, Artificial Sequence
  spacer sequence
cucauuauaaccucauuuua

SEQ ID NO: 9552 - RNA, 20 nt, Artificial Sequence
  spacer sequence
aaaagguaacuaucucucau

SEQ ID NO: 9553 - RNA, 20 nt, Artificial Sequence
  spacer sequence
ucaaaaagguaacuaucucu

SEQ ID NO: 9554 - RNA, 20 nt, Artificial Sequence
  spacer sequence
acuauuugaacuacaugcuu

SEQ ID NO: 9555 - RNA, 20 nt, Artificial Sequence
  spacer sequence
aauaguagaaaaguucauca

SEQ ID NO: 9556 - RNA, 20 nt, Artificial Sequence
  spacer sequence
gcuuuauaagcauguaguuc

SEQ ID NO: 9557 - RNA, 20 nt, Artificial Sequence
  spacer sequence
uuucagcuuuauaagcaugu

SEQ ID NO: 9558 - RNA, 20 nt, Artificial Sequence
  spacer sequence
uaauucuuuucagcuuuaua

SEQ ID NO: 9559 - RNA, 20 nt, Artificial Sequence
  spacer sequence
cuuaauucuuuucagcuuua

SEQ ID NO: 9560 - RNA, 20 nt, Artificial Sequence
  spacer sequence
guuuacuuauuucuacauuu

SEQ ID NO: 9561 - RNA, 20 nt, Artificial Sequence
  spacer sequence
aauuauaggaaauguagaaa

SEQ ID NO: 9562 - RNA, 20 nt, Artificial Sequence
  spacer sequence
uaaaacucugaaaucuauac

SEQ ID NO: 9563 - RNA, 20 nt, Artificial Sequence
  spacer sequence
gaaaucuauacaaucuaaau

SEQ ID NO: 9564 - RNA, 20 nt, Artificial Sequence
  spacer sequence
gaguuuuaagaauuuucuaa

SEQ ID NO: 9565 - RNA, 20 nt, Artificial Sequence
  spacer sequence
auacaaucuaaauauuauca

SEQ ID NO: 9566 - RNA, 20 nt, Artificial Sequence
  spacer sequence
aaauauuaucaauacugaau

SEQ ID NO: 9567 - RNA, 20 nt, Artificial Sequence
  spacer sequence
auacugaaugaaccaugaga

SEQ ID NO: 9568 - RNA, 20 nt, Artificial Sequence
  spacer sequence
guauugauaauauuuagauu

SEQ ID NO: 9569 - RNA, 20 nt, Artificial Sequence
  spacer sequence
uucaguauugauaauauuua

SEQ ID NO: 9570 - RNA, 20 nt, Artificial Sequence
  spacer sequence
ugguucauucaguauugaua

SEQ ID NO: 9571 - RNA, 20 nt, Artificial Sequence
  spacer sequence
caugguucauucaguauuga

SEQ ID NO: 9572 - RNA, 20 nt, Artificial Sequence
  spacer sequence
aaauuucaaaaagauuucuc

SEQ ID NO: 9573 - RNA, 20 nt, Artificial Sequence
  spacer sequence
aaaagauuucucaaauugcu

SEQ ID NO: 9574 - RNA, 20 nt, Artificial Sequence
  spacer sequence
uuuugaaauuuugaaaauau

SEQ ID NO: 9575 - RNA, 20 nt, Artificial Sequence
  spacer sequence
caaauugcuuuauuuuauca

SEQ ID NO: 9576 - RNA, 20 nt, Artificial Sequence
  spacer sequence
aauugcuuuauuuuaucauu

SEQ ID NO: 9577 - RNA, 20 nt, Artificial Sequence
  spacer sequence
uuaccuuaauagcuuuaaua

SEQ ID NO: 9578 - RNA, 20 nt, Artificial Sequence
  spacer sequence
cuaaagcugcuauuaaagcu

SEQ ID NO: 9579 - RNA, 20 nt, Artificial Sequence
  spacer sequence
ucacuaaagcugcuauuaaa

SEQ ID NO: 9580 - RNA, 20 nt, Artificial Sequence
  spacer sequence
caucacuaaagcugcuauua

SEQ ID NO: 9581 - RNA, 20 nt, Artificial Sequence
  spacer sequence
ucuuggcucuagagauggga

SEQ ID NO: 9582 - RNA, 20 nt, Artificial Sequence
  spacer sequence
uggcucuagagaugggaggu

SEQ ID NO: 9583 - RNA, 20 nt, Artificial Sequence
  spacer sequence
agagaugggagguuucauau

SEQ ID NO: 9584 - RNA, 20 nt, Artificial Sequence
  spacer sequence
agagccaagaugauucucau

SEQ ID NO: 9585 - RNA, 20 nt, Artificial Sequence
  spacer sequence
cuagagccaagaugauucuc

SEQ ID NO: 9586 - RNA, 20 nt, Artificial Sequence
  spacer sequence
caucucuagagccaagauga

SEQ ID NO: 9587 - RNA, 20 nt, Artificial Sequence
  spacer sequence
uauccauaagcgaaaagagc

SEQ ID NO: 9588 - RNA, 20 nt, Artificial Sequence
  spacer sequence
auaagcgaaaagagcuuaaa

SEQ ID NO: 9589 - RNA, 20 nt, Artificial Sequence
  spacer sequence
cuuauggauaugaaaccucc

SEQ ID NO: 9590 - RNA, 20 nt, Artificial Sequence
  spacer sequence
uuucgcuuauggauaugaaa

SEQ ID NO: 9591 - RNA, 20 nt, Artificial Sequence
  spacer sequence
uuuaagcucuuuucgcuuau

SEQ ID NO: 9592 - RNA, 20 nt, Artificial Sequence
  spacer sequence
ccaccccuuuggcagagcua

SEQ ID NO: 9593 - RNA, 20 nt, Artificial Sequence
  spacer sequence
cuaccccuucgccaccccuu

SEQ ID NO: 9594 - RNA, 20 nt, Artificial Sequence
  spacer sequence
uuucacuaccccuucgccac

SEQ ID NO: 9595 - RNA, 20 nt, Artificial Sequence
  spacer sequence
uucauuucacuaccccuucg

SEQ ID NO: 9596 - RNA, 20 nt, Artificial Sequence
  spacer sequence
uccuucauuucacuaccccu

SEQ ID NO: 9597 - RNA, 20 nt, Artificial Sequence
  spacer sequence
ugggcucuuccuucauuuca

SEQ ID NO: 9598 - RNA, 20 nt, Artificial Sequence
  spacer sequence
gcauggcugucagcuaaacc

SEQ ID NO: 9599 - RNA, 20 nt, Artificial Sequence
  spacer sequence
gcuaaaccugcuccugcaaa

SEQ ID NO: 9600 - RNA, 20 nt, Artificial Sequence
  spacer sequence
ugcaaaaguggaaaugaggc

SEQ ID NO: 9601 - RNA, 20 nt, Artificial Sequence
  spacer sequence
acuuuugcaggagcagguuu

SEQ ID NO: 9602 - RNA, 20 nt, Artificial Sequence
  spacer sequence
uuuccacuuuugcaggagca

SEQ ID NO: 9603 - RNA, 20 nt, Artificial Sequence
  spacer sequence
gccucauuuccacuuuugca

SEQ ID NO: 9604 - RNA, 20 nt, Artificial Sequence
  spacer sequence
gcugccuuuuuucagccuca

SEQ ID NO: 9605 - RNA, 20 nt, Artificial Sequence
  spacer sequence
uuagacaaagaugugcaaac

SEQ ID NO: 9606 - RNA, 20 nt, Artificial Sequence
  spacer sequence
aaggauuuauacuucugcug

SEQ ID NO: 9607 - RNA, 20 nt, Artificial Sequence
  spacer sequence
uugucuaaggauuuauacuu

SEQ ID NO: 9608 - RNA, 20 nt, Artificial Sequence
  spacer sequence
cuuuuguuugcacaucuuug

SEQ ID NO: 9609 - RNA, 20 nt, Artificial Sequence
  spacer sequence
cuuucccuuuuguuugcaca

SEQ ID NO: 9610 - RNA, 20 nt, Artificial Sequence
  spacer sequence
cccucccuuucccuuuuguu

SEQ ID NO: 9611 - RNA, 20 nt, Artificial Sequence
  spacer sequence
uugcucccccucccuuuccc

SEQ ID NO: 9612 - RNA, 20 nt, Artificial Sequence
  spacer sequence
cuuugcucccccucccuuuc

SEQ ID NO: 9613 - RNA, 20 nt, Artificial Sequence
  spacer sequence
guuuucucuuugcucccccu

SEQ ID NO: 9614 - RNA, 20 nt, Artificial Sequence
  spacer sequence
agugacuaaccaagaaacua

SEQ ID NO: 9615 - RNA, 20 nt, Artificial Sequence
  spacer sequence
cuugagucuguuuucucuuu

SEQ ID NO: 9616 - RNA, 20 nt, Artificial Sequence
  spacer sequence
ugguuagucacuugagucug

SEQ ID NO: 9617 - RNA, 20 nt, Artificial Sequence
  spacer sequence
uuaguuucuugguuagucac

SEQ ID NO: 9618 - RNA, 20 nt, Artificial Sequence
  spacer sequence
gcagguaaaucuuuaguuuc

SEQ ID NO: 9619 - RNA, 20 nt, Artificial Sequence
  spacer sequence
guuuucugcagguaaaucuu

SEQ ID NO: 9620 - RNA, 20 nt, Artificial Sequence
  spacer sequence
ccguuuucugcagguaaauc

SEQ ID NO: 9621 - RNA, 20 nt, Artificial Sequence
  spacer sequence
uugguuuuaguuucuccguu

SEQ ID NO: 9622 - RNA, 20 nt, Artificial Sequence
  spacer sequence
cauugguuuuaguuucuccg

SEQ ID NO: 9623 - RNA, 20 nt, Artificial Sequence
  spacer sequence
agccucugaugaagccagag

SEQ ID NO: 9624 - RNA, 20 nt, Artificial Sequence
  spacer sequence
gaugaagccagagaaagaag

SEQ ID NO: 9625 - RNA, 20 nt, Artificial Sequence
  spacer sequence
gaggcuggacucucauuggu

SEQ ID NO: 9626 - RNA, 20 nt, Artificial Sequence
  spacer sequence
ucagaggcuggacucucauu

SEQ ID NO: 9627 - RNA, 20 nt, Artificial Sequence
  spacer sequence
ggcuucaucagaggcuggac

SEQ ID NO: 9628 - RNA, 20 nt, Artificial Sequence
  spacer sequence
cuggcuucaucagaggcugg

SEQ ID NO: 9629 - RNA, 20 nt, Artificial Sequence
  spacer sequence
uucucuggcuucaucagagg

SEQ ID NO: 9630 - RNA, 20 nt, Artificial Sequence
  spacer sequence
acucaguacauaccaugucu

SEQ ID NO: 9631 - RNA, 20 nt, Artificial Sequence
  spacer sequence
guacauaccaugucuuauca

SEQ ID NO: 9632 - RNA, 20 nt, Artificial Sequence
  spacer sequence
uaucaguggucucugucucc

SEQ ID NO: 9633 - RNA, 20 nt, Artificial Sequence
  spacer sequence
guggucucugucuccccucu

SEQ ID NO: 9634 - RNA, 20 nt, Artificial Sequence
  spacer sequence
cugucuccccucucuucaau

SEQ ID NO: 9635 - RNA, 20 nt, Artificial Sequence
  spacer sequence
gucuccccucucuucaaucc

SEQ ID NO: 9636 - RNA, 20 nt, Artificial Sequence
  spacer sequence
ccccucucuucaauccagag

SEQ ID NO: 9637 - RNA, 20 nt, Artificial Sequence
  spacer sequence
ccucucuucaauccagagga

SEQ ID NO: 9638 - RNA, 20 nt, Artificial Sequence
  spacer sequence
cuucaauccagaggaguauu

SEQ ID NO: 9639 - RNA, 20 nt, Artificial Sequence
  spacer sequence
ucaauccagaggaguauuuu

SEQ ID NO: 9640 - RNA, 20 nt, Artificial Sequence
  spacer sequence
auccagaggaguauuuuuau

SEQ ID NO: 9641 - RNA, 20 nt, Artificial Sequence
  spacer sequence
agaggaguauuuuuaucaac

SEQ ID NO: 9642 - RNA, 20 nt, Artificial Sequence
  spacer sequence
ggauugaagagaggggagac

SEQ ID NO: 9643 - RNA, 20 nt, Artificial Sequence
  spacer sequence
ucuggauugaagagagggga

SEQ ID NO: 9644 - RNA, 20 nt, Artificial Sequence
  spacer sequence
acuauuuuguaaaugcaaga

SEQ ID NO: 9645 - RNA, 20 nt, Artificial Sequence
  spacer sequence
ugcauuuacaaaauaguuga

SEQ ID NO: 9646 - RNA, 20 nt, Artificial Sequence
  spacer sequence
agaaacauuuuuaaggaggg

SEQ ID NO: 9647 - RNA, 20 nt, Artificial Sequence
  spacer sequence
agaccuacuaaaaucuugca

SEQ ID NO: 9648 - RNA, 20 nt, Artificial Sequence
  spacer sequence
uuaaaaauguuucuagaccu

SEQ ID NO: 9649 - RNA, 20 nt, Artificial Sequence
  spacer sequence
cuccuuaaaaauguuucuag

SEQ ID NO: 9650 - RNA, 20 nt, Artificial Sequence
  spacer sequence
caguucaucccauuuuuuau

SEQ ID NO: 9651 - RNA, 20 nt, Artificial Sequence
  spacer sequence
ucccauuuuuuauguauaaa

SEQ ID NO: 9652 - RNA, 20 nt, Artificial Sequence
  spacer sequence
cauuuuuuauguauaaaugc

SEQ ID NO: 9653 - RNA, 20 nt, Artificial Sequence
  spacer sequence
uaaaaaaaagcauuuauaca

SEQ ID NO: 9654 - RNA, 20 nt, Artificial Sequence
  spacer sequence
uucacugguuguuuacuuua

SEQ ID NO: 9655 - RNA, 20 nt, Artificial Sequence
  spacer sequence
cugguuguuuacuuuauuuu

SEQ ID NO: 9656 - RNA, 20 nt, Artificial Sequence
  spacer sequence
gguuguaccaaaaaauaaag

SEQ ID NO: 9657 - RNA, 20 nt, Artificial Sequence
  spacer sequence
guucugguuguaccaaaaaa

SEQ ID NO: 9658 - RNA, 20 nt, Artificial Sequence
  spacer sequence
cacacucuguucugguugua

SEQ ID NO: 9659 - RNA, 20 nt, Artificial Sequence
  spacer sequence
cauaauacaacaucccacac

SEQ ID NO: 9660 - RNA, 20 nt, Artificial Sequence
  spacer sequence
aagccucccauaauacaaca

SEQ ID NO: 9661 - RNA, 20 nt, Artificial Sequence
  spacer sequence
ugggugucagcuuaacauuc

SEQ ID NO: 9662 - RNA, 20 nt, Artificial Sequence
  spacer sequence
gcuuaacauuccauagaugg

SEQ ID NO: 9663 - RNA, 20 nt, Artificial Sequence
  spacer sequence
auagauggggggguuacuuu

SEQ ID NO: 9664 - RNA, 20 nt, Artificial Sequence
  spacer sequence
auggaauguuaagcugacac

SEQ ID NO: 9665 - RNA, 20 nt, Artificial Sequence
  spacer sequence
uauaaugucucuacuaaaua

SEQ ID NO: 9666 - RNA, 20 nt, Artificial Sequence
  spacer sequence
cuacuaaauauacaaauauu

SEQ ID NO: 9667 - RNA, 20 nt, Artificial Sequence
  spacer sequence
acuaaauauacaaauauuag

SEQ ID NO: 9668 - RNA, 20 nt, Artificial Sequence
  spacer sequence
cagguaaguguaugcuuaug

SEQ ID NO: 9669 - RNA, 20 nt, Artificial Sequence
  spacer sequence
aaaagauauugugaaguaag

SEQ ID NO: 9670 - RNA, 20 nt, Artificial Sequence
  spacer sequence
uuuggaagucccagguaagu

SEQ ID NO: 9671 - RNA, 20 nt, Artificial Sequence
  spacer sequence
caauaucuuuuggaaguccc

SEQ ID NO: 9672 - RNA, 20 nt, Artificial Sequence
  spacer sequence
gagaucccaacauuaugaaa

SEQ ID NO: 9673 - RNA, 20 nt, Artificial Sequence
  spacer sequence
gaaacuuacuucacaauauc

SEQ ID NO: 9674 - RNA, 20 nt, Artificial Sequence
  spacer sequence
cugaaacuuacuucacaaua

SEQ ID NO: 9675 - RNA, 20 nt, Artificial Sequence
  spacer sequence
caacauuaugaaacucauau

SEQ ID NO: 9676 - RNA, 20 nt, Artificial Sequence
  spacer sequence
uaauguugggaucucugaaa

SEQ ID NO: 9677 - RNA, 20 nt, Artificial Sequence
  spacer sequence
uaugaaucacauuuccauuc

SEQ ID NO: 9678 - RNA, 20 nt, Artificial Sequence
  spacer sequence
uaugaguuucauaauguugg

SEQ ID NO: 9679 - RNA, 20 nt, Artificial Sequence
  spacer sequence
cauuuccauucuuucaauuu

SEQ ID NO: 9680 - RNA, 20 nt, Artificial Sequence
  spacer sequence
ucauuguauuacuucauuua

SEQ ID NO: 9681 - RNA, 20 nt, Artificial Sequence
  spacer sequence
uuguauuacuucauuuacca

SEQ ID NO: 9682 - RNA, 20 nt, Artificial Sequence
  spacer sequence
uuuaccaauguaauaaaaaa

SEQ ID NO: 9683 - RNA, 20 nt, Artificial Sequence
  spacer sequence
uugagaauaaaacgcucacu

SEQ ID NO: 9684 - RNA, 20 nt, Artificial Sequence
  spacer sequence
aagauaauuuuuuuauuaca

SEQ ID NO: 9685 - RNA, 20 nt, Artificial Sequence
  spacer sequence
caaagauaauuuuuuuauua

SEQ ID NO: 9686 - RNA, 20 nt, Artificial Sequence
  spacer sequence
cuaacugaaaggcaauuaga

SEQ ID NO: 9687 - RNA, 20 nt, Artificial Sequence
  spacer sequence
guuagugagcguuuuauucu

SEQ ID NO: 9688 - RNA, 20 nt, Artificial Sequence
  spacer sequence
aauugccuuucaguuaguga

SEQ ID NO: 9689 - RNA, 20 nt, Artificial Sequence
  spacer sequence
uuucuaauugccuuucaguu

SEQ ID NO: 9690 - RNA, 20 nt, Artificial Sequence
  spacer sequence
ugccuguaaucccagcacuu

SEQ ID NO: 9691 - RNA, 20 nt, Artificial Sequence
  spacer sequence
cagcuacuugggaggcugag

SEQ ID NO: 9692 - RNA, 20 nt, Artificial Sequence
  spacer sequence
caaguagcugggacuacagg

SEQ ID NO: 9693 - RNA, 20 nt, Artificial Sequence
  spacer sequence
gccucccaaguagcugggac

SEQ ID NO: 9694 - RNA, 20 nt, Artificial Sequence
  spacer sequence
ugccucagccucccaaguag

SEQ ID NO: 9695 - RNA, 20 nt, Artificial Sequence
  spacer sequence
ccugccucagccucccaagu

SEQ ID NO: 9696 - RNA, 20 nt, Artificial Sequence
  spacer sequence
cuugaacccaggaggcggac

SEQ ID NO: 9697 - RNA, 20 nt, Artificial Sequence
  spacer sequence
agcgauucuccugccucagc

SEQ ID NO: 9698 - RNA, 20 nt, Artificial Sequence
  spacer sequence
uggguucaagcgauucuccu

SEQ ID NO: 9699 - RNA, 20 nt, Artificial Sequence
  spacer sequence
gccuccuggguucaagcgau

SEQ ID NO: 9700 - RNA, 20 nt, Artificial Sequence
  spacer sequence
guccgccuccuggguucaag

SEQ ID NO: 9701 - RNA, 20 nt, Artificial Sequence
  spacer sequence
uacugguuuguauaauuuua

SEQ ID NO: 9702 - RNA, 20 nt, Artificial Sequence
  spacer sequence
acuuaaacacaaauucuaaa

SEQ ID NO: 9703 - RNA, 20 nt, Artificial Sequence
  spacer sequence
aaaaauaucaacacuguaug

SEQ ID NO: 9704 - RNA, 20 nt, Artificial Sequence
  spacer sequence
acacuguaugauuuauaaau

SEQ ID NO: 9705 - RNA, 20 nt, Artificial Sequence
  spacer sequence
uacaguguugauauuuuuag

SEQ ID NO: 9706 - RNA, 20 nt, Artificial Sequence
  spacer sequence
guuauaaaaucuauuaagac

SEQ ID NO: 9707 - RNA, 20 nt, Artificial Sequence
  spacer sequence
auuaagacaguugcuuauua

SEQ ID NO: 9708 - RNA, 20 nt, Artificial Sequence
  spacer sequence
uaauagauuuuauaacagaa

SEQ ID NO: 9709 - RNA, 20 nt, Artificial Sequence
  spacer sequence
auuuucuauaccuuaacaca

SEQ ID NO: 9710 - RNA, 20 nt, Artificial Sequence
  spacer sequence
auaccuuaacacagugaaag

SEQ ID NO: 9711 - RNA, 20 nt, Artificial Sequence
  spacer sequence
cuguguuaagguauagaaaa

SEQ ID NO: 9712 - RNA, 20 nt, Artificial Sequence
  spacer sequence
ccuuucacuguguuaaggua

SEQ ID NO: 9713 - RNA, 20 nt, Artificial Sequence
  spacer sequence
uaaugaacacacccacacac

SEQ ID NO: 9714 - RNA, 20 nt, Artificial Sequence
  spacer sequence
uuaagaccuauggguuuuug

SEQ ID NO: 9715 - RNA, 20 nt, Artificial Sequence
  spacer sequence
uggguugucuccacaacucu

SEQ ID NO: 9716 - RNA, 20 nt, Artificial Sequence
  spacer sequence
ccacaacucuucaaugauuu

SEQ ID NO: 9717 - RNA, 20 nt, Artificial Sequence
  spacer sequence
acaacucuucaaugauuuau

SEQ ID NO: 9718 - RNA, 20 nt, Artificial Sequence
  spacer sequence
ucaaugauuuaugcaaaaau

SEQ ID NO: 9719 - RNA, 20 nt, Artificial Sequence
  spacer sequence
augauuuaugcaaaaauccu

SEQ ID NO: 9720 - RNA, 20 nt, Artificial Sequence
  spacer sequence
uugaagaguuguggagacaa

SEQ ID NO: 9721 - RNA, 20 nt, Artificial Sequence
  spacer sequence
ugaagaaacuagaaacccuc

SEQ ID NO: 9722 - RNA, 20 nt, Artificial Sequence
  spacer sequence
ggauuuuugcauaaaucauu

SEQ ID NO: 9723 - RNA, 20 nt, Artificial Sequence
  spacer sequence
ucaggauuuuugcauaaauc

SEQ ID NO: 9724 - RNA, 20 nt, Artificial Sequence
  spacer sequence
aguuucuucaggauuuuugc

SEQ ID NO: 9725 - RNA, 20 nt, Artificial Sequence
  spacer sequence
cuuccuuguucucaaccucc

SEQ ID NO: 9726 - RNA, 20 nt, Artificial Sequence
  spacer sequence
uuguucucaaccuccugagu

SEQ ID NO: 9727 - RNA, 20 nt, Artificial Sequence
  spacer sequence
caaccuccugagucaagacc

SEQ ID NO: 9728 - RNA, 20 nt, Artificial Sequence
  spacer sequence
accuccugagucaagaccac

SEQ ID NO: 9729 - RNA, 20 nt, Artificial Sequence
  spacer sequence
ugagucaagaccacuucuug

SEQ ID NO: 9730 - RNA, 20 nt, Artificial Sequence
  spacer sequence
ggagguugagaacaaggaag

SEQ ID NO: 9731 - RNA, 20 nt, Artificial Sequence
  spacer sequence
agaccacuucuugaugugau

SEQ ID NO: 9732 - RNA, 20 nt, Artificial Sequence
  spacer sequence
ugacucaggagguugagaac

SEQ ID NO: 9733 - RNA, 20 nt, Artificial Sequence
  spacer sequence
ugaugugauucaugccaaac

SEQ ID NO: 9734 - RNA, 20 nt, Artificial Sequence
  spacer sequence
agaaguggucuugacucagg

SEQ ID NO: 9735 - RNA, 20 nt, Artificial Sequence
  spacer sequence
caucaagaaguggucuugac

SEQ ID NO: 9736 - RNA, 20 nt, Artificial Sequence
  spacer sequence
ugccaaacacuuaagacacu

SEQ ID NO: 9737 - RNA, 20 nt, Artificial Sequence
  spacer sequence
uaaguguuuggcaugaauca

SEQ ID NO: 9738 - RNA, 20 nt, Artificial Sequence
  spacer sequence
aaaauauagcagugucuuaa

SEQ ID NO: 9739 - RNA, 20 nt, Artificial Sequence
  spacer sequence
auccaaaauauagcaguguc

SEQ ID NO: 9740 - RNA, 20 nt, Artificial Sequence
  spacer sequence
uuaauaauaaaguagaagca

SEQ ID NO: 9741 - RNA, 20 nt, Artificial Sequence
  spacer sequence
acuuuauuauuaaagauuua

SEQ ID NO: 9742 - RNA, 20 nt, Artificial Sequence
  spacer sequence
acguagaaagucaagagggu

SEQ ID NO: 9743 - RNA, 20 nt, Artificial Sequence
  spacer sequence
acguggaaaggccccuuauu

SEQ ID NO: 9744 - RNA, 20 nt, Artificial Sequence
  spacer sequence
agagggugaggauggccagg

SEQ ID NO: 9745 - RNA, 20 nt, Artificial Sequence
  spacer sequence
ugacuuucuacguggaaagg

SEQ ID NO: 9746 - RNA, 20 nt, Artificial Sequence
  spacer sequence
cccucuugacuuucuacgug

SEQ ID NO: 9747 - RNA, 20 nt, Artificial Sequence
  spacer sequence
ucacccucuugacuuucuac

SEQ ID NO: 9748 - RNA, 20 nt, Artificial Sequence
  spacer sequence
uggccauccucacccucuug

SEQ ID NO: 9749 - RNA, 20 nt, Artificial Sequence
  spacer sequence
uggcuccuggccauccucac

SEQ ID NO: 9750 - RNA, 20 nt, Artificial Sequence
  spacer sequence
cuuucuuggcuccuggccau

SEQ ID NO: 9751 - RNA, 20 nt, Artificial Sequence
  spacer sequence
aaauguauauccaaggcagu

SEQ ID NO: 9752 - RNA, 20 nt, Artificial Sequence
  spacer sequence
aaggcagucuggaacuuuca

SEQ ID NO: 9753 - RNA, 20 nt, Artificial Sequence
  spacer sequence
ggaacuuucaugcagguaca

SEQ ID NO: 9754 - RNA, 20 nt, Artificial Sequence
  spacer sequence
agacugccuuggauauacau

SEQ ID NO: 9755 - RNA, 20 nt, Artificial Sequence
  spacer sequence
ugcagguacaagaaacuuau

SEQ ID NO: 9756 - RNA, 20 nt, Artificial Sequence
  spacer sequence
uguaccugcaugaaaguucc

SEQ ID NO: 9757 - RNA, 20 nt, Artificial Sequence
  spacer sequence
aaguagccacaagauuauuu

SEQ ID NO: 9758 - RNA, 20 nt, Artificial Sequence
  spacer sequence
uguggcuacuuugacauaag

SEQ ID NO: 9759 - RNA, 20 nt, Artificial Sequence
  spacer sequence
uaggagaugaacaaauguga

SEQ ID NO: 9760 - RNA, 20 nt, Artificial Sequence
  spacer sequence
uaugaaauaaucuuguggcu

SEQ ID NO: 9761 - RNA, 20 nt, Artificial Sequence
  spacer sequence
ccuaugaaauaaucuugugg

SEQ ID NO: 9762 - RNA, 20 nt, Artificial Sequence
  spacer sequence
ucuccuaugaaauaaucuug

SEQ ID NO: 9763 - RNA, 20 nt, Artificial Sequence
  spacer sequence
cauuuguucaucuccuauga

SEQ ID NO: 9764 - RNA, 20 nt, Artificial Sequence
  spacer sequence
aagcuuugugugaaaucucu

SEQ ID NO: 9765 - RNA, 20 nt, Artificial Sequence
  spacer sequence
cacaaagcuuugauuuuuag

SEQ ID NO: 9766 - RNA, 20 nt, Artificial Sequence
  spacer sequence
cuaauuuauggagaagcuag

SEQ ID NO: 9767 - RNA, 20 nt, Artificial Sequence
  spacer sequence
aauuuauggagaagcuaggu

SEQ ID NO: 9768 - RNA, 20 nt, Artificial Sequence
  spacer sequence
auaaauuagagauuucacac

SEQ ID NO: 9769 - RNA, 20 nt, Artificial Sequence
  spacer sequence
ccauaaauuagagauuucac

SEQ ID NO: 9770 - RNA, 20 nt, Artificial Sequence
  spacer sequence
uaccuagcuucuccauaaau

SEQ ID NO: 9771 - RNA, 20 nt, Artificial Sequence
  spacer sequence
ccugucuguucuuuuccuga

SEQ ID NO: 9772 - RNA, 20 nt, Artificial Sequence
  spacer sequence
guucuuuuccugaucccuuc

SEQ ID NO: 9773 - RNA, 20 nt, Artificial Sequence
  spacer sequence
uuuccugaucccuucuccuc

SEQ ID NO: 9774 - RNA, 20 nt, Artificial Sequence
  spacer sequence
ugaucccuucuccucauuuc

SEQ ID NO: 9775 - RNA, 20 nt, Artificial Sequence
  spacer sequence
ggaaaagaacagacagguga

SEQ ID NO: 9776 - RNA, 20 nt, Artificial Sequence
  spacer sequence
cuucuccucauuuccugaaa

SEQ ID NO: 9777 - RNA, 20 nt, Artificial Sequence
  spacer sequence
ccucauuuccugaaauguag

SEQ ID NO: 9778 - RNA, 20 nt, Artificial Sequence
  spacer sequence
ucauuuccugaaauguagag

SEQ ID NO: 9779 - RNA, 20 nt, Artificial Sequence
  spacer sequence
uuuccugaaauguagagacu

SEQ ID NO: 9780 - RNA, 20 nt, Artificial Sequence
  spacer sequence
ugaaauguagagacugaggc

SEQ ID NO: 9781 - RNA, 20 nt, Artificial Sequence
  spacer sequence
ggaaaugaggagaagggauc

SEQ ID NO: 9782 - RNA, 20 nt, Artificial Sequence
  spacer sequence
acauuucaggaaaugaggag

SEQ ID NO: 9783 - RNA, 20 nt, Artificial Sequence
  spacer sequence
cuacauuucaggaaaugagg

SEQ ID NO: 9784 - RNA, 20 nt, Artificial Sequence
  spacer sequence
gucucuacauuucaggaaau

SEQ ID NO: 9785 - RNA, 20 nt, Artificial Sequence
  spacer sequence
ccaucacugugggggugggg

SEQ ID NO: 9786 - RNA, 20 nt, Artificial Sequence
  spacer sequence
cugugggggugggggggagc

SEQ ID NO: 9787 - RNA, 20 nt, Artificial Sequence
  spacer sequence
cccccacccccacagugaug

SEQ ID NO: 9788 - RNA, 20 nt, Artificial Sequence
  spacer sequence
auuuugaugguugauuuugc

SEQ ID NO: 9789 - RNA, 20 nt, Artificial Sequence
  spacer sequence
aaauagacgcucccccccac

SEQ ID NO: 9790 - RNA, 20 nt, Artificial Sequence
  spacer sequence
accaucaaaauagacgcucc

SEQ ID NO: 9791 - RNA, 20 nt, Artificial Sequence
  spacer sequence
gcaaaaucaaccaucaaaau

SEQ ID NO: 9792 - RNA, 20 nt, Artificial Sequence
  spacer sequence
uuucccauuuucuaaugauu

SEQ ID NO: 9793 - RNA, 20 nt, Artificial Sequence
  spacer sequence
cauuuucuaaugauuuugua

SEQ ID NO: 9794 - RNA, 20 nt, Artificial Sequence
  spacer sequence
aaugauuuuguaacauacaa

SEQ ID NO: 9795 - RNA, 20 nt, Artificial Sequence
  spacer sequence
uuagaaaaugggaaaggaag

SEQ ID NO: 9796 - RNA, 20 nt, Artificial Sequence
  spacer sequence
guuuguauguuacaaaauca

SEQ ID NO: 9797 - RNA, 20 nt, Artificial Sequence
  spacer sequence
uuucccuucccuucuccuuc

SEQ ID NO: 9798 - RNA, 20 nt, Artificial Sequence
  spacer sequence
cuucccuucuccuuccccug

SEQ ID NO: 9799 - RNA, 20 nt, Artificial Sequence
  spacer sequence
cuucuccuuccccugggaaa

SEQ ID NO: 9800 - RNA, 20 nt, Artificial Sequence
  spacer sequence
ccuuccccugggaaaauaca

SEQ ID NO: 9801 - RNA, 20 nt, Artificial Sequence
  spacer sequence
uuccccugggaaaauacaac

SEQ ID NO: 9802 - RNA, 20 nt, Artificial Sequence
  spacer sequence
ccugggaaaauacaacgaau

SEQ ID NO: 9803 - RNA, 20 nt, Artificial Sequence
  spacer sequence
caggggaaggagaagggaag

SEQ ID NO: 9804 - RNA, 20 nt, Artificial Sequence
  spacer sequence
uuguauuuucccaggggaag

SEQ ID NO: 9805 - RNA, 20 nt, Artificial Sequence
  spacer sequence
guaccaguaaguauuuauuc

SEQ ID NO: 9806 - RNA, 20 nt, Artificial Sequence
  spacer sequence
aaaaaaaaaaaaagaaagaa

SEQ ID NO: 9807 - RNA, 20 nt, Artificial Sequence
  spacer sequence
uuuuuuuuuuuuugacaguu

SEQ ID NO: 9808 - RNA, 20 nt, Artificial Sequence
  spacer sequence
uucuuuuuuuuuuuuuugac

SEQ ID NO: 9809 - RNA, 20 nt, Artificial Sequence
  spacer sequence
uucuuucuuuuuuuuuuuuu

SEQ ID NO: 9810 - RNA, 20 nt, Artificial Sequence
  spacer sequence
cuggucauuaaaagcuuaga

SEQ ID NO: 9811 - RNA, 20 nt, Artificial Sequence
  spacer sequence
ggucauuaaaagcuuagagu

SEQ ID NO: 9812 - RNA, 20 nt, Artificial Sequence
  spacer sequence
uuaaaagcuuagaguaaauu

SEQ ID NO: 9813 - RNA, 20 nt, Artificial Sequence
  spacer sequence
aagcuuuuaaugaccagaga

SEQ ID NO: 9814 - RNA, 20 nt, Artificial Sequence
  spacer sequence
uuaaaauuuacucuaagcuu

SEQ ID NO: 9815 - RNA, 20 nt, Artificial Sequence
  spacer sequence
ggcuuagguuuccuuaaaau

SEQ ID NO: 9816 - RNA, 20 nt, Artificial Sequence
  spacer sequence
ucuaaugcccccaaaaagca

SEQ ID NO: 9817 - RNA, 20 nt, Artificial Sequence
  spacer sequence
aaugcccccaaaaagcacuu

SEQ ID NO: 9818 - RNA, 20 nt, Artificial Sequence
  spacer sequence
guuuuagaugaugccuaggc

SEQ ID NO: 9819 - RNA, 20 nt, Artificial Sequence
  spacer sequence
aaaacagauaugacccuuuu

SEQ ID NO: 9820 - RNA, 20 nt, Artificial Sequence
  spacer sequence
ucuaaaacagauaugacccu

SEQ ID NO: 9821 - RNA, 20 nt, Artificial Sequence
  spacer sequence
uggccuaggcaucaucuaaa

SEQ ID NO: 9822 - RNA, 20 nt, Artificial Sequence
  spacer sequence
gaacuaauauuuguugauuc

SEQ ID NO: 9823 - RNA, 20 nt, Artificial Sequence
  spacer sequence
gaucauggccuaggcaucau

SEQ ID NO: 9824 - RNA, 20 nt, Artificial Sequence
  spacer sequence
acaaauauuaguucagauca

SEQ ID NO: 9825 - RNA, 20 nt, Artificial Sequence
  spacer sequence
aaaguucacacucccuaaca

SEQ ID NO: 9826 - RNA, 20 nt, Artificial Sequence
  spacer sequence
cacucccuaacaacauaccc

SEQ ID NO: 9827 - RNA, 20 nt, Artificial Sequence
  spacer sequence
cuaacaacauacccauaccc

SEQ ID NO: 9828 - RNA, 20 nt, Artificial Sequence
  spacer sequence
cugcaaccuucgccuccuga

SEQ ID NO: 9829 - RNA, 20 nt, Artificial Sequence
  spacer sequence
gcucacugcaaccuucgccu

SEQ ID NO: 9830 - RNA, 20 nt, Artificial Sequence
  spacer sequence
cggcucacugcaaccuucgc

SEQ ID NO: 9831 - RNA, 20 nt, Artificial Sequence
  spacer sequence
agccugggauacagaccgag

SEQ ID NO: 9832 - RNA, 20 nt, Artificial Sequence
  spacer sequence
caggcuggaguguaguggca

SEQ ID NO: 9833 - RNA, 20 nt, Artificial Sequence
  spacer sequence
guaucccaggcuggagugua

SEQ ID NO: 9834 - RNA, 20 nt, Artificial Sequence
  spacer sequence
gucuguaucccaggcuggag

SEQ ID NO: 9835 - RNA, 20 nt, Artificial Sequence
  spacer sequence
cggucuguaucccaggcugg

SEQ ID NO: 9836 - RNA, 20 nt, Artificial Sequence
  spacer sequence
gucuccaaaaacaaaaaaca

SEQ ID NO: 9837 - RNA, 20 nt, Artificial Sequence
  spacer sequence
ccaaaaacaaaaaacaaaca

SEQ ID NO: 9838 - RNA, 20 nt, Artificial Sequence
  spacer sequence
aaaaacaaaaaacaaacaaa

SEQ ID NO: 9839 - RNA, 20 nt, Artificial Sequence
  spacer sequence
guuuugugguuuuuuuguuu

SEQ ID NO: 9840 - RNA, 20 nt, Artificial Sequence
  spacer sequence
ucuguuuugugguuuuuuug

SEQ ID NO: 9841 - RNA, 20 nt, Artificial Sequence
  spacer sequence
auguagcagagaaaaaaccu

SEQ ID NO: 9842 - RNA, 20 nt, Artificial Sequence
  spacer sequence
gcuacauugaaauuuuuggu

SEQ ID NO: 9843 - RNA, 20 nt, Artificial Sequence
  spacer sequence
cugcuacauugaaauuuuug

SEQ ID NO: 9844 - RNA, 20 nt, Artificial Sequence
  spacer sequence
uuuuugcagguuuuuucucu

SEQ ID NO: 9845 - RNA, 20 nt, Artificial Sequence
  spacer sequence
uggugcucauuuuugcaggu

SEQ ID NO: 9846 - RNA, 20 nt, Artificial Sequence
  spacer sequence
acuuuguccuggugcucauu

SEQ ID NO: 9847 - RNA, 20 nt, Artificial Sequence
  spacer sequence
cagaaauuagagacaucugg

SEQ ID NO: 9848 - RNA, 20 nt, Artificial Sequence
  spacer sequence
gggauucuacuuuguccugg

SEQ ID NO: 9849 - RNA, 20 nt, Artificial Sequence
  spacer sequence
aauuucugggauucuacuuu

SEQ ID NO: 9850 - RNA, 20 nt, Artificial Sequence
  spacer sequence
cuaauuucugggauucuacu

SEQ ID NO: 9851 - RNA, 20 nt, Artificial Sequence
  spacer sequence
ggcauagccaaaugcuacaa

SEQ ID NO: 9852 - RNA, 20 nt, Artificial Sequence
  spacer sequence
uguagcauuuggcuaugcca

SEQ ID NO: 9853 - RNA, 20 nt, Artificial Sequence
  spacer sequence
ggaugcaaaacaaaucuugu

SEQ ID NO: 9854 - RNA, 20 nt, Artificial Sequence
  spacer sequence
ugauuaaccucuuguagcau

SEQ ID NO: 9855 - RNA, 20 nt, Artificial Sequence
  spacer sequence
uguuuauuuaguuuggcaau

SEQ ID NO: 9856 - RNA, 20 nt, Artificial Sequence
  spacer sequence
ccuaauugccaaacuaaaua

SEQ ID NO: 9857 - RNA, 20 nt, Artificial Sequence
  spacer sequence
cuugcauucaccuaauugcc

SEQ ID NO: 9858 - RNA, 20 nt, Artificial Sequence
  spacer sequence
guuuuugaaagugauuccaa

SEQ ID NO: 9859 - RNA, 20 nt, Artificial Sequence
  spacer sequence
aaaacugaugucacuugcau

SEQ ID NO: 9860 - RNA, 20 nt, Artificial Sequence
  spacer sequence
cuuucaaaaacugaugucac

SEQ ID NO: 9861 - RNA, 20 nt, Artificial Sequence
  spacer sequence
aaauuccaacugguuaagga

SEQ ID NO: 9862 - RNA, 20 nt, Artificial Sequence
  spacer sequence
aacugguuaaggaaugagug

SEQ ID NO: 9863 - RNA, 20 nt, Artificial Sequence
  spacer sequence
uuaaccaguuggaauuugga

SEQ ID NO: 9864 - RNA, 20 nt, Artificial Sequence
  spacer sequence
uuccuuaaccaguuggaauu

SEQ ID NO: 9865 - RNA, 20 nt, Artificial Sequence
  spacer sequence
uugccugccacucauuccuu

SEQ ID NO: 9866 - RNA, 20 nt, Artificial Sequence
  spacer sequence
guuuccuugccugccacuca

SEQ ID NO: 9867 - RNA, 20 nt, Artificial Sequence
  spacer sequence
uuuuucauuaauucaacaaa

SEQ ID NO: 9868 - RNA, 20 nt, Artificial Sequence
  spacer sequence
uuaauucaacaaauaucuga

SEQ ID NO: 9869 - RNA, 20 nt, Artificial Sequence
  spacer sequence
acaaauaucugagagcuuag

SEQ ID NO: 9870 - RNA, 20 nt, Artificial Sequence
  spacer sequence
gagagcuuaguaaguggcaa

SEQ ID NO: 9871 - RNA, 20 nt, Artificial Sequence
  spacer sequence
gauauuuguugaauuaauga

SEQ ID NO: 9872 - RNA, 20 nt, Artificial Sequence
  spacer sequence
cagauauuuguugaauuaau

SEQ ID NO: 9873 - RNA, 20 nt, Artificial Sequence
  spacer sequence
gcuugccacuuacuaagcuc

SEQ ID NO: 9874 - RNA, 20 nt, Artificial Sequence
  spacer sequence
uauauaaaaaggagacagga

SEQ ID NO: 9875 - RNA, 20 nt, Artificial Sequence
  spacer sequence
uuuuuauauacgaaacacuc

SEQ ID NO: 9876 - RNA, 20 nt, Artificial Sequence
  spacer sequence
ccuuuuuauauacgaaacac

SEQ ID NO: 9877 - RNA, 20 nt, Artificial Sequence
  spacer sequence
ugucuccuuuuuauauacga

SEQ ID NO: 9878 - RNA, 20 nt, Artificial Sequence
  spacer sequence
aagcuuuuuuauaaaugacc

SEQ ID NO: 9879 - RNA, 20 nt, Artificial Sequence
  spacer sequence
uuuauaaaaaagcuuugaaa

SEQ ID NO: 9880 - RNA, 20 nt, Artificial Sequence
  spacer sequence
uauuuguuagcauuauaaag

SEQ ID NO: 9881 - RNA, 20 nt, Artificial Sequence
  spacer sequence
aucacaucacuuucuuucuu

SEQ ID NO: 9882 - RNA, 20 nt, Artificial Sequence
  spacer sequence
caucacuuucuuucuuuuuu

SEQ ID NO: 9883 - RNA, 20 nt, Artificial Sequence
  spacer sequence
cuuucuuucuuuuuuuaaac

SEQ ID NO: 9884 - RNA, 20 nt, Artificial Sequence
  spacer sequence
uucuuuuuuuaaacuccuga

SEQ ID NO: 9885 - RNA, 20 nt, Artificial Sequence
  spacer sequence
uuuuuuaaacuccugaguuc

SEQ ID NO: 9886 - RNA, 20 nt, Artificial Sequence
  spacer sequence
ugaguucaagugauccuccc

SEQ ID NO: 9887 - RNA, 20 nt, Artificial Sequence
  spacer sequence
ggaguuuaaaaaaagaaaga

SEQ ID NO: 9888 - RNA, 20 nt, Artificial Sequence
  spacer sequence
agugauccucccaucucagc

SEQ ID NO: 9889 - RNA, 20 nt, Artificial Sequence
  spacer sequence
cuugaacucaggaguuuaaa

SEQ ID NO: 9890 - RNA, 20 nt, Artificial Sequence
  spacer sequence
ucccaucucagcuuccccag

SEQ ID NO: 9891 - RNA, 20 nt, Artificial Sequence
  spacer sequence
caucucagcuuccccagcag

SEQ ID NO: 9892 - RNA, 20 nt, Artificial Sequence
  spacer sequence
cagcuuccccagcagcugga

SEQ ID NO: 9893 - RNA, 20 nt, Artificial Sequence
  spacer sequence
gcuuccccagcagcuggaac

SEQ ID NO: 9894 - RNA, 20 nt, Artificial Sequence
  spacer sequence
ccagcagcuggaacuauagg

SEQ ID NO: 9895 - RNA, 20 nt, Artificial Sequence
  spacer sequence
agcugcuggggaagcugaga

SEQ ID NO: 9896 - RNA, 20 nt, Artificial Sequence
  spacer sequence
ggugggguggcacaugccua

SEQ ID NO: 9897 - RNA, 20 nt, Artificial Sequence
  spacer sequence
cuggugggguggcacaugcc

SEQ ID NO: 9898 - RNA, 20 nt, Artificial Sequence
  spacer sequence
uuugggaugacuuuuauucu

SEQ ID NO: 9899 - RNA, 20 nt, Artificial Sequence
  spacer sequence
caaaagaaacuucucuggug

SEQ ID NO: 9900 - RNA, 20 nt, Artificial Sequence
  spacer sequence
ucccaaaagaaacuucucug

SEQ ID NO: 9901 - RNA, 20 nt, Artificial Sequence
  spacer sequence
ccuuuaccaacauuuuucuu

SEQ ID NO: 9902 - RNA, 20 nt, Artificial Sequence
  spacer sequence
uuuaccaacauuuuucuuaa

SEQ ID NO: 9903 - RNA, 20 nt, Artificial Sequence
  spacer sequence
uaaaauuucaagcugugcau

SEQ ID NO: 9904 - RNA, 20 nt, Artificial Sequence
  spacer sequence
agcugugcauuugcauuuga

SEQ ID NO: 9905 - RNA, 20 nt, Artificial Sequence
  spacer sequence
aaugcaaaugcacagcuuga

SEQ ID NO: 9906 - RNA, 20 nt, Artificial Sequence
  spacer sequence
uaaauuauaucaaaugcaaa

SEQ ID NO: 9907 - RNA, 20 nt, Artificial Sequence
  spacer sequence
ucguaaauuauaucaaaugc

SEQ ID NO: 9908 - RNA, 20 nt, Artificial Sequence
  spacer sequence
cuguaguguuuuucuucgua

SEQ ID NO: 9909 - RNA, 20 nt, Artificial Sequence
  spacer sequence
guauuucccuguaguguuuu

SEQ ID NO: 9910 - RNA, 20 nt, Artificial Sequence
  spacer sequence
aaauuggagguuugcaaaau

SEQ ID NO: 9911 - RNA, 20 nt, Artificial Sequence
  spacer sequence
aauuuugaaaaaucuguauu

SEQ ID NO: 9912 - RNA, 20 nt, Artificial Sequence
  spacer sequence
ccuuuuaacagucaaugaau

SEQ ID NO: 9913 - RNA, 20 nt, Artificial Sequence
  spacer sequence
augaaugcuguuaauauuuu

SEQ ID NO: 9914 - RNA, 20 nt, Artificial Sequence
  spacer sequence
uugacuguuaaaaggugauu

SEQ ID NO: 9915 - RNA, 20 nt, Artificial Sequence
  spacer sequence
auaaaauauuaacagcauuc

SEQ ID NO: 9916 - RNA, 20 nt, Artificial Sequence
  spacer sequence
ccaaacggucucuaccuuuu

SEQ ID NO: 9917 - RNA, 20 nt, Artificial Sequence
  spacer sequence
cuaccuuuugcaagacaaaa

SEQ ID NO: 9918 - RNA, 20 nt, Artificial Sequence
  spacer sequence
accuuuugcaagacaaaaaa

SEQ ID NO: 9919 - RNA, 20 nt, Artificial Sequence
  spacer sequence
ugcaaaagguagagaccguu

SEQ ID NO: 9920 - RNA, 20 nt, Artificial Sequence
  spacer sequence
ugcugacacuuucuuccuaa

SEQ ID NO: 9921 - RNA, 20 nt, Artificial Sequence
  spacer sequence
aaauaaaucaugcugacacu

SEQ ID NO: 9922 - RNA, 20 nt, Artificial Sequence
  spacer sequence
ucuaaauaaaucaugcugac

SEQ ID NO: 9923 - RNA, 20 nt, Artificial Sequence
  spacer sequence
aaauacugaucaaauuucaa

SEQ ID NO: 9924 - RNA, 20 nt, Artificial Sequence
  spacer sequence
guauuuugaucaucuaaaua

SEQ ID NO: 9925 - RNA, 20 nt, Artificial Sequence
  spacer sequence
aauuucaauuucucaagacu

SEQ ID NO: 9926 - RNA, 20 nt, Artificial Sequence
  spacer sequence
auuucucaagacuaaagguc

SEQ ID NO: 9927 - RNA, 20 nt, Artificial Sequence
  spacer sequence
caagacuaaaggucaauaca

SEQ ID NO: 9928 - RNA, 20 nt, Artificial Sequence
  spacer sequence
agacuaaaggucaauacacu

SEQ ID NO: 9929 - RNA, 20 nt, Artificial Sequence
  spacer sequence
ugagaaauugaaauuugauc

SEQ ID NO: 9930 - RNA, 20 nt, Artificial Sequence
  spacer sequence
auacacuguuuuuauguuuu

SEQ ID NO: 9931 - RNA, 20 nt, Artificial Sequence
  spacer sequence
aaaacauaaaaacaguguau

SEQ ID NO: 9932 - RNA, 20 nt, Artificial Sequence
  spacer sequence
gaauguauaacaugcuggcu

SEQ ID NO: 9933 - RNA, 20 nt, Artificial Sequence
  spacer sequence
uauuucugaauauugacuca

SEQ ID NO: 9934 - RNA, 20 nt, Artificial Sequence
  spacer sequence
gaauauugacucauccaaau

SEQ ID NO: 9935 - RNA, 20 nt, Artificial Sequence
  spacer sequence
gaaauaagaauuucugaaug

SEQ ID NO: 9936 - RNA, 20 nt, Artificial Sequence
  spacer sequence
auauucagaaauaagaauuu

SEQ ID NO: 9937 - RNA, 20 nt, Artificial Sequence
  spacer sequence
uccaaauauuuccagguaag

SEQ ID NO: 9938 - RNA, 20 nt, Artificial Sequence
  spacer sequence
aaauauuuccagguaagaca

SEQ ID NO: 9939 - RNA, 20 nt, Artificial Sequence
  spacer sequence
agguaagacaugggcccucu

SEQ ID NO: 9940 - RNA, 20 nt, Artificial Sequence
  spacer sequence
uaccuggaaauauuuggaug

SEQ ID NO: 9941 - RNA, 20 nt, Artificial Sequence
  spacer sequence
acuguugccaguucugcuga

SEQ ID NO: 9942 - RNA, 20 nt, Artificial Sequence
  spacer sequence
gcugaguuugauucucccau

SEQ ID NO: 9943 - RNA, 20 nt, Artificial Sequence
  spacer sequence
gcagaacuggcaacaguaga

SEQ ID NO: 9944 - RNA, 20 nt, Artificial Sequence
  spacer sequence
aacucagcagaacuggcaac

SEQ ID NO: 9945 - RNA, 20 nt, Artificial Sequence
  spacer sequence
ugcuauuaacaguuuuauaa

SEQ ID NO: 9946 - RNA, 20 nt, Artificial Sequence
  spacer sequence
uuucaugcuauuaacaguuu

SEQ ID NO: 9947 - RNA, 20 nt, Artificial Sequence
  spacer sequence
aaaauaaucagugcuuaaua

SEQ ID NO: 9948 - RNA, 20 nt, Artificial Sequence
  spacer sequence
gugcuuaauaaaugucuugg

SEQ ID NO: 9949 - RNA, 20 nt, Artificial Sequence
  spacer sequence
uggucucuaacuccuacccc

SEQ ID NO: 9950 - RNA, 20 nt, Artificial Sequence
  spacer sequence
cuaacuccuacccccucuca

SEQ ID NO: 9951 - RNA, 20 nt, Artificial Sequence
  spacer sequence
aacuccuacccccucucaca

SEQ ID NO: 9952 - RNA, 20 nt, Artificial Sequence
  spacer sequence
uacccccucucacauacacc

SEQ ID NO: 9953 - RNA, 20 nt, Artificial Sequence
  spacer sequence
cacauacaccaauccccgac

SEQ ID NO: 9954 - RNA, 20 nt, Artificial Sequence
  spacer sequence
cauacaccaauccccgacuu

SEQ ID NO: 9955 - RNA, 20 nt, Artificial Sequence
  spacer sequence
uaaauaaaagaguuaauugu

SEQ ID NO: 9956 - RNA, 20 nt, Artificial Sequence
  spacer sequence
uuuauuuaagauuaauaaau

SEQ ID NO: 9957 - RNA, 20 nt, Artificial Sequence
  spacer sequence
uggucaccaauauuguuuga

SEQ ID NO: 9958 - RNA, 20 nt, Artificial Sequence
  spacer sequence
ccaauauuguuugaggaauc

SEQ ID NO: 9959 - RNA, 20 nt, Artificial Sequence
  spacer sequence
aacaauauuggugaccauga

SEQ ID NO: 9960 - RNA, 20 nt, Artificial Sequence
  spacer sequence
ucaaacaauauuggugacca

SEQ ID NO: 9961 - RNA, 20 nt, Artificial Sequence
  spacer sequence
cucaagagaaguauauaaug

SEQ ID NO: 9962 - RNA, 20 nt, Artificial Sequence
  spacer sequence
caagagaaguauauaauguu

SEQ ID NO: 9963 - RNA, 20 nt, Artificial Sequence
  spacer sequence
agagaaguauauaauguugu

SEQ ID NO: 9964 - RNA, 20 nt, Artificial Sequence
  spacer sequence
ugagagauuccucaaacaau

SEQ ID NO: 9965 - RNA, 20 nt, Artificial Sequence
  spacer sequence
cuugagagauuccucaaaca

SEQ ID NO: 9966 - RNA, 20 nt, Artificial Sequence
  spacer sequence
ccacaacauuauauacuucu

SEQ ID NO: 9967 - RNA, 20 nt, Artificial Sequence
  spacer sequence
aagauuuugauugauuuucc

SEQ ID NO: 9968 - RNA, 20 nt, Artificial Sequence
  spacer sequence
ccauuuuacagauggaggaa

SEQ ID NO: 9969 - RNA, 20 nt, Artificial Sequence
  spacer sequence
cuccuuauuuaguuaagucu

SEQ ID NO: 9970 - RNA, 20 nt, Artificial Sequence
  spacer sequence
uuauuuaguuaagucuaaga

SEQ ID NO: 9971 - RNA, 20 nt, Artificial Sequence
  spacer sequence
aagaauuaaauacaaacaau

SEQ ID NO: 9972 - RNA, 20 nt, Artificial Sequence
  spacer sequence
uagacuuaacuaaauaagga

SEQ ID NO: 9973 - RNA, 20 nt, Artificial Sequence
  spacer sequence
aagugcuuuuguauguauug

SEQ ID NO: 9974 - RNA, 20 nt, Artificial Sequence
  spacer sequence
cugccccccccaccccaccc

SEQ ID NO: 9975 - RNA, 20 nt, Artificial Sequence
  spacer sequence
ucccugccccccccacccca

SEQ ID NO: 9976 - RNA, 20 nt, Artificial Sequence
  spacer sequence
gaaaaaaacuucauguuuuu

SEQ ID NO: 9977 - RNA, 20 nt, Artificial Sequence
  spacer sequence
gacauggcagugcuucuucc

SEQ ID NO: 9978 - RNA, 20 nt, Artificial Sequence
  spacer sequence
uguuuuucaaucaaguuuag

SEQ ID NO: 9979 - RNA, 20 nt, Artificial Sequence
  spacer sequence
aucaaguuuagauacacaua

SEQ ID NO: 9980 - RNA, 20 nt, Artificial Sequence
  spacer sequence
aguuuagauacacauaagua

SEQ ID NO: 9981 - RNA, 20 nt, Artificial Sequence
  spacer sequence
aaacuugauugaaaaacaug

SEQ ID NO: 9982 - RNA, 20 nt, Artificial Sequence
  spacer sequence
auauacaaaaacucauuuag

SEQ ID NO: 9983 - RNA, 20 nt, Artificial Sequence
  spacer sequence
uuccauauacaaaaacucau

SEQ ID NO: 9984 - RNA, 20 nt, Artificial Sequence
  spacer sequence
uacuaugucaccccgcagag

SEQ ID NO: 9985 - RNA, 20 nt, Artificial Sequence
  spacer sequence
ccccgcagaggacaaguauu

SEQ ID NO: 9986 - RNA, 20 nt, Artificial Sequence
  spacer sequence
gcggggugacauaguacgag

SEQ ID NO: 9987 - RNA, 20 nt, Artificial Sequence
  spacer sequence
ucugcggggugacauaguac

SEQ ID NO: 9988 - RNA, 20 nt, Artificial Sequence
  spacer sequence
auaaacaccguuaggugcag

SEQ ID NO: 9989 - RNA, 20 nt, Artificial Sequence
  spacer sequence
gcaccuaacgguguuuauug

SEQ ID NO: 9990 - RNA, 20 nt, Artificial Sequence
  spacer sequence
cccaacauuauagccuguau

SEQ ID NO: 9991 - RNA, 20 nt, Artificial Sequence
  spacer sequence
caauuaauguuaucugugaa

SEQ ID NO: 9992 - RNA, 20 nt, Artificial Sequence
  spacer sequence
gugaaugaauaaaaaguguc

SEQ ID NO: 9993 - RNA, 20 nt, Artificial Sequence
  spacer sequence
cagauaacauuaauugugaa

SEQ ID NO: 9994 - RNA, 20 nt, Artificial Sequence
  spacer sequence
uucacagauaacauuaauug

SEQ ID NO: 9995 - RNA, 20 nt, Artificial Sequence
  spacer sequence
aagcagccagagaaaaccau

SEQ ID NO: 9996 - RNA, 20 nt, Artificial Sequence
  spacer sequence
ggcugcuuugacacuuuuua

SEQ ID NO: 9997 - RNA, 20 nt, Artificial Sequence
  spacer sequence
cuggcugcuuugacacuuuu

SEQ ID NO: 9998 - RNA, 20 nt, Artificial Sequence
  spacer sequence
ugguuuucucuggcugcuuu

SEQ ID NO: 9999 - RNA, 20 nt, Artificial Sequence
  spacer sequence
uccugcauaaaaauaacaac

SEQ ID NO: 10000 - RNA, 20 nt, Artificial Sequence
  spacer sequence
ugcauaaaaauaacaacagc

SEQ ID NO: 10001 - RNA, 20 nt, Artificial Sequence
  spacer sequence
aaauacaagacuucuuuaga

SEQ ID NO: 10002 - RNA, 20 nt, Artificial Sequence
  spacer sequence
uguauuuggaggggcuguug

SEQ ID NO: 10003 - RNA, 20 nt, Artificial Sequence
  spacer sequence
uuagaagggauaagcauagu

SEQ ID NO: 10004 - RNA, 20 nt, Artificial Sequence
  spacer sequence
aaagaagucuuguauuugga

SEQ ID NO: 10005 - RNA, 20 nt, Artificial Sequence
  spacer sequence
cuucuaaagaagucuuguau

SEQ ID NO: 10006 - RNA, 20 nt, Artificial Sequence
  spacer sequence
acuaugcuuaucccuucuaa

SEQ ID NO: 10007 - RNA, 20 nt, Artificial Sequence
  spacer sequence
uuuccacuaugcuuaucccu

SEQ ID NO: 10008 - RNA, 20 nt, Artificial Sequence
  spacer sequence
gcaguagauaugagcuuggc

SEQ ID NO: 10009 - RNA, 20 nt, Artificial Sequence
  spacer sequence
acugcugacaaguagcauuc

SEQ ID NO: 10010 - RNA, 20 nt, Artificial Sequence
  spacer sequence
uaucuacugcugacaaguag

SEQ ID NO: 10011 - RNA, 20 nt, Artificial Sequence
  spacer sequence
uugcuuugucacuagcagaa

SEQ ID NO: 10012 - RNA, 20 nt, Artificial Sequence
  spacer sequence
cuagcagaaugacuaugaaa

SEQ ID NO: 10013 - RNA, 20 nt, Artificial Sequence
  spacer sequence
gcuagugacaaagcaaagag

SEQ ID NO: 10014 - RNA, 20 nt, Artificial Sequence
  spacer sequence
uucugcuagugacaaagcaa

SEQ ID NO: 10015 - RNA, 20 nt, Artificial Sequence
  spacer sequence
uagucauucugcuagugaca

SEQ ID NO: 10016 - RNA, 20 nt, Artificial Sequence
  spacer sequence
aaauaugaccacugcccugc

SEQ ID NO: 10017 - RNA, 20 nt, Artificial Sequence
  spacer sequence
uauuuagacguuuucauagu

SEQ ID NO: 10018 - RNA, 20 nt, Artificial Sequence
  spacer sequence
ugcagcagggcaguggucau

SEQ ID NO: 10019 - RNA, 20 nt, Artificial Sequence
  spacer sequence
auaugucaugcagcagggca

SEQ ID NO: 10020 - RNA, 20 nt, Artificial Sequence
  spacer sequence
ggcuucuauaugucaugcag

SEQ ID NO: 10021 - RNA, 20 nt, Artificial Sequence
  spacer sequence
caggcuucuauaugucaugc

SEQ ID NO: 10022 - RNA, 20 nt, Artificial Sequence
  spacer sequence
ucuaaaaauuaugaagaaug

SEQ ID NO: 10023 - RNA, 20 nt, Artificial Sequence
  spacer sequence
aaaaauuaugaagaaugauu

SEQ ID NO: 10024 - RNA, 20 nt, Artificial Sequence
  spacer sequence
uaauuuuuagaggauuuugu

SEQ ID NO: 10025 - RNA, 20 nt, Artificial Sequence
  spacer sequence
ucauaauuuuuagaggauuu

SEQ ID NO: 10026 - RNA, 20 nt, Artificial Sequence
  spacer sequence
uucuucauaauuuuuagagg

SEQ ID NO: 10027 - RNA, 20 nt, Artificial Sequence
  spacer sequence
uccugaucccucauaccagu

SEQ ID NO: 10028 - RNA, 20 nt, Artificial Sequence
  spacer sequence
ugaucccucauaccaguaaa

SEQ ID NO: 10029 - RNA, 20 nt, Artificial Sequence
  spacer sequence
ggaugaaucauucuucauaa

SEQ ID NO: 10030 - RNA, 20 nt, Artificial Sequence
  spacer sequence
cucauaccaguaaagaguuu

SEQ ID NO: 10031 - RNA, 20 nt, Artificial Sequence
  spacer sequence
uaccaguaaagaguuucaag

SEQ ID NO: 10032 - RNA, 20 nt, Artificial Sequence
  spacer sequence
uuacugguaugagggaucag

SEQ ID NO: 10033 - RNA, 20 nt, Artificial Sequence
  spacer sequence
agugaagauaaagaagaacg

SEQ ID NO: 10034 - RNA, 20 nt, Artificial Sequence
  spacer sequence
cuugaaacucuuuacuggua

SEQ ID NO: 10035 - RNA, 20 nt, Artificial Sequence
  spacer sequence
ucacuugaaacucuuuacug

SEQ ID NO: 10036 - RNA, 20 nt, Artificial Sequence
  spacer sequence
uuaucuucacuugaaacucu

SEQ ID NO: 10037 - RNA, 20 nt, Artificial Sequence
  spacer sequence
ucuuuaucuucacuugaaac

SEQ ID NO: 10038 - RNA, 20 nt, Artificial Sequence
  spacer sequence
uucuucuuuaucuucacuug

SEQ ID NO: 10039 - RNA, 20 nt, Artificial Sequence
  spacer sequence
ggccugugauaccugcagaa

SEQ ID NO: 10040 - RNA, 20 nt, Artificial Sequence
  spacer sequence
caggccagauacccucguuc

SEQ ID NO: 10041 - RNA, 20 nt, Artificial Sequence
  spacer sequence
gcagguaucacaggccagau

SEQ ID NO: 10042 - RNA, 20 nt, Artificial Sequence
  spacer sequence
caauguuuagggauuaguca

SEQ ID NO: 10043 - RNA, 20 nt, Artificial Sequence
  spacer sequence
cuaaacauugugaauucugc

SEQ ID NO: 10044 - RNA, 20 nt, Artificial Sequence
  spacer sequence
aaguaacauggguacucugc

SEQ ID NO: 10045 - RNA, 20 nt, Artificial Sequence
  spacer sequence
gcuauuuaccaguggcauaa

SEQ ID NO: 10046 - RNA, 20 nt, Artificial Sequence
  spacer sequence
accuuucuaaacuccaagga

SEQ ID NO: 10047 - RNA, 20 nt, Artificial Sequence
  spacer sequence
aaacuccaaggauuuuuaaa

SEQ ID NO: 10048 - RNA, 20 nt, Artificial Sequence
  spacer sequence
aaggauuuuuaaaaucugaa

SEQ ID NO: 10049 - RNA, 20 nt, Artificial Sequence
  spacer sequence
uuggaguuuagaaagguuga

SEQ ID NO: 10050 - RNA, 20 nt, Artificial Sequence
  spacer sequence
gaaaaacaggaauuaauggg

SEQ ID NO: 10051 - RNA, 20 nt, Artificial Sequence
  spacer sequence
gauuuuaaaaauccuuggag

SEQ ID NO: 10052 - RNA, 20 nt, Artificial Sequence
  spacer sequence
uguuuuucagauuuuaaaaa

SEQ ID NO: 10053 - RNA, 20 nt, Artificial Sequence
  spacer sequence
ccucaccacauuguuaggau

SEQ ID NO: 10054 - RNA, 20 nt, Artificial Sequence
  spacer sequence
ccacauuguuaggauuaaau

SEQ ID NO: 10055 - RNA, 20 nt, Artificial Sequence
  spacer sequence
uaacaauguggugaggugag

SEQ ID NO: 10056 - RNA, 20 nt, Artificial Sequence
  spacer sequence
uauuuaauccuaacaaugug

SEQ ID NO: 10057 - RNA, 20 nt, Artificial Sequence
  spacer sequence
cuuagcccaguaccuaacac

SEQ ID NO: 10058 - RNA, 20 nt, Artificial Sequence
  spacer sequence
uagcccaguaccuaacacau

SEQ ID NO: 10059 - RNA, 20 nt, Artificial Sequence
  spacer sequence
gcacuuauguguuagguacu

SEQ ID NO: 10060 - RNA, 20 nt, Artificial Sequence
  spacer sequence
auuuacucagcacuuaugug

SEQ ID NO: 10061 - RNA, 20 nt, Artificial Sequence
  spacer sequence
cauuguuuugcuccauuuac

SEQ ID NO: 10062 - RNA, 20 nt, Artificial Sequence
  spacer sequence
ucacauuguuuugcuccauu

SEQ ID NO: 10063 - RNA, 20 nt, Artificial Sequence
  spacer sequence
ucucuguucuuuaacuauua

SEQ ID NO: 10064 - RNA, 20 nt, Artificial Sequence
  spacer sequence
cuguucuuuaacuauuagcc

SEQ ID NO: 10065 - RNA, 20 nt, Artificial Sequence
  spacer sequence
guucuuuaacuauuagccaa

SEQ ID NO: 10066 - RNA, 20 nt, Artificial Sequence
  spacer sequence
uuaacuauuagccaaaugau

SEQ ID NO: 10067 - RNA, 20 nt, Artificial Sequence
  spacer sequence
uuuggcuaauaguuaaagaa

SEQ ID NO: 10068 - RNA, 20 nt, Artificial Sequence
  spacer sequence
agaugauccugguuaauucc

SEQ ID NO: 10069 - RNA, 20 nt, Artificial Sequence
  spacer sequence
ggaaaccuuaucauuuggcu

SEQ ID NO: 10070 - RNA, 20 nt, Artificial Sequence
  spacer sequence
ucuggaaaccuuaucauuug

SEQ ID NO: 10071 - RNA, 20 nt, Artificial Sequence
  spacer sequence
ugguuaauucccuuuaagua

SEQ ID NO: 10072 - RNA, 20 nt, Artificial Sequence
  spacer sequence
cuuuaaguaugguauccuca

SEQ ID NO: 10073 - RNA, 20 nt, Artificial Sequence
  spacer sequence
ucaaauggacaggguccgga

SEQ ID NO: 10074 - RNA, 20 nt, Artificial Sequence
  spacer sequence
aauggacaggguccggacgu

SEQ ID NO: 10075 - RNA, 20 nt, Artificial Sequence
  spacer sequence
auuugaggauaccauacuua

SEQ ID NO: 10076 - RNA, 20 nt, Artificial Sequence
  spacer sequence
ggacguaguccugcacugug

SEQ ID NO: 10077 - RNA, 20 nt, Artificial Sequence
  spacer sequence
ggacccuguccauuugagga

SEQ ID NO: 10078 - RNA, 20 nt, Artificial Sequence
  spacer sequence
ugcacugugaauuggcuuuu

SEQ ID NO: 10079 - RNA, 20 nt, Artificial Sequence
  spacer sequence
cagugcaggacuacguccgg

SEQ ID NO: 10080 - RNA, 20 nt, Artificial Sequence
  spacer sequence
uauuucuguaguaagaaauu

SEQ ID NO: 10081 - RNA, 20 nt, Artificial Sequence
  spacer sequence
guaguaagaaauuaccacaa

SEQ ID NO: 10082 - RNA, 20 nt, Artificial Sequence
  spacer sequence
uacuacagaaauaggaaacu

SEQ ID NO: 10083 - RNA, 20 nt, Artificial Sequence
  spacer sequence
aaaguguaauuuguguugcu

SEQ ID NO: 10084 - RNA, 20 nt, Artificial Sequence
  spacer sequence
gaaucucacuagcaucagca

SEQ ID NO: 10085 - RNA, 20 nt, Artificial Sequence
  spacer sequence
gaccucaaaaguguaauuug

SEQ ID NO: 10086 - RNA, 20 nt, Artificial Sequence
  spacer sequence
cacuagcaucagcaaggcga

SEQ ID NO: 10087 - RNA, 20 nt, Artificial Sequence
  spacer sequence
cuagcaucagcaaggcgaca

SEQ ID NO: 10088 - RNA, 20 nt, Artificial Sequence
  spacer sequence
gcaaggcgacauuccuugua

SEQ ID NO: 10089 - RNA, 20 nt, Artificial Sequence
  spacer sequence
ccuugcugaugcuagugaga

SEQ ID NO: 10090 - RNA, 20 nt, Artificial Sequence
  spacer sequence
uuguaaaggcucuagggaag

SEQ ID NO: 10091 - RNA, 20 nt, Artificial Sequence
  spacer sequence
agggaagaaucuauuucuug

SEQ ID NO: 10092 - RNA, 20 nt, Artificial Sequence
  spacer sequence
cuagagccuuuacaaggaau

SEQ ID NO: 10093 - RNA, 20 nt, Artificial Sequence
  spacer sequence
ucccuagagccuuuacaagg

SEQ ID NO: 10094 - RNA, 20 nt, Artificial Sequence
  spacer sequence
auuucuugucuaaucuugcu

SEQ ID NO: 10095 - RNA, 20 nt, Artificial Sequence
  spacer sequence
ugucuaaucuugcuucuaca

SEQ ID NO: 10096 - RNA, 20 nt, Artificial Sequence
  spacer sequence
aaucuugcuucuacagggug

SEQ ID NO: 10097 - RNA, 20 nt, Artificial Sequence
  spacer sequence
ugcuucuacagggugccuac

SEQ ID NO: 10098 - RNA, 20 nt, Artificial Sequence
  spacer sequence
acagggugccuacauucuuu

SEQ ID NO: 10099 - RNA, 20 nt, Artificial Sequence
  spacer sequence
uuuggcucauggccucuucu

SEQ ID NO: 10100 - RNA, 20 nt, Artificial Sequence
  spacer sequence
uggccucuucuuccaucuuc

SEQ ID NO: 10101 - RNA, 20 nt, Artificial Sequence
  spacer sequence
ucuuccaucuucaaagccag

SEQ ID NO: 10102 - RNA, 20 nt, Artificial Sequence
  spacer sequence
uccaucuucaaagccagcag

SEQ ID NO: 10103 - RNA, 20 nt, Artificial Sequence
  spacer sequence
aucuucaaagccagcaguau

SEQ ID NO: 10104 - RNA, 20 nt, Artificial Sequence
  spacer sequence
ucaaagccagcaguauagca

SEQ ID NO: 10105 - RNA, 20 nt, Artificial Sequence
  spacer sequence
aagccagcaguauagcaucu

SEQ ID NO: 10106 - RNA, 20 nt, Artificial Sequence
  spacer sequence
ucuccuucuaucucuucugu

SEQ ID NO: 10107 - RNA, 20 nt, Artificial Sequence
  spacer sequence
ccuucuaucucuucuguugu

SEQ ID NO: 10108 - RNA, 20 nt, Artificial Sequence
  spacer sequence
uucuaucucuucuguuguuu

SEQ ID NO: 10109 - RNA, 20 nt, Artificial Sequence
  spacer sequence
aucucuucuguuguuuuauu

SEQ ID NO: 10110 - RNA, 20 nt, Artificial Sequence
  spacer sequence
cuucuguuguuuuauuuccu

SEQ ID NO: 10111 - RNA, 20 nt, Artificial Sequence
  spacer sequence
ucuguuguuuuauuuccuuc

SEQ ID NO: 10112 - RNA, 20 nt, Artificial Sequence
  spacer sequence
guuguuuuauuuccuucuuu

SEQ ID NO: 10113 - RNA, 20 nt, Artificial Sequence
  spacer sequence
uucuuugacuccuaccucuc

SEQ ID NO: 10114 - RNA, 20 nt, Artificial Sequence
  spacer sequence
uugacuccuaccucucuagu

SEQ ID NO: 10115 - RNA, 20 nt, Artificial Sequence
  spacer sequence
aagaaggaaauaaaacaaca

SEQ ID NO: 10116 - RNA, 20 nt, Artificial Sequence
  spacer sequence
uaccucucuaguauaaggac

SEQ ID NO: 10117 - RNA, 20 nt, Artificial Sequence
  spacer sequence
cuaguauaaggacccuuaug

SEQ ID NO: 10118 - RNA, 20 nt, Artificial Sequence
  spacer sequence
aguauaaggacccuuaugau

SEQ ID NO: 10119 - RNA, 20 nt, Artificial Sequence
  spacer sequence
uuauacuagagagguaggag

SEQ ID NO: 10120 - RNA, 20 nt, Artificial Sequence
  spacer sequence
uaaggguccuuauacuagag

SEQ ID NO: 10121 - RNA, 20 nt, Artificial Sequence
  spacer sequence
gggugggcccgguguaauca

SEQ ID NO: 10122 - RNA, 20 nt, Artificial Sequence
  spacer sequence
aggauaauuaacccgucuca

SEQ ID NO: 10123 - RNA, 20 nt, Artificial Sequence
  spacer sequence
uggauuaucugggugggccc

SEQ ID NO: 10124 - RNA, 20 nt, Artificial Sequence
  spacer sequence
caacauucuuaaccuuauuc

SEQ ID NO: 10125 - RNA, 20 nt, Artificial Sequence
  spacer sequence
acauucuuaaccuuauucac

SEQ ID NO: 10126 - RNA, 20 nt, Artificial Sequence
  spacer sequence
uaaccuuauucacaucccca

SEQ ID NO: 10127 - RNA, 20 nt, Artificial Sequence
  spacer sequence
cauccccagucucuuuugcc

SEQ ID NO: 10128 - RNA, 20 nt, Artificial Sequence
  spacer sequence
ccagucucuuuugccuugca

SEQ ID NO: 10129 - RNA, 20 nt, Artificial Sequence
  spacer sequence
cuuuugccuugcaagguaau

SEQ ID NO: 10130 - RNA, 20 nt, Artificial Sequence
  spacer sequence
uuugccuugcaagguaauau

SEQ ID NO: 10131 - RNA, 20 nt, Artificial Sequence
  spacer sequence
aaaaccuguaaauauauuac

SEQ ID NO: 10132 - RNA, 20 nt, Artificial Sequence
  spacer sequence
aauucuaaaaccuguaaaua

SEQ ID NO: 10133 - RNA, 20 nt, Artificial Sequence
  spacer sequence
uaaucuaauucuaaaaccug

SEQ ID NO: 10134 - RNA, 20 nt, Artificial Sequence
  spacer sequence
uuggagaagggggcauuauu

SEQ ID NO: 10135 - RNA, 20 nt, Artificial Sequence
  spacer sequence
aaagauguucauaaucuaau

SEQ ID NO: 10136 - RNA, 20 nt, Artificial Sequence
  spacer sequence
ccaaagauguucauaaucua

SEQ ID NO: 10137 - RNA, 20 nt, Artificial Sequence
  spacer sequence
uuaacuccaauuuguaauca

SEQ ID NO: 10138 - RNA, 20 nt, Artificial Sequence
  spacer sequence
aauuuguaaucaucugaaau

SEQ ID NO: 10139 - RNA, 20 nt, Artificial Sequence
  spacer sequence
ucugaaaucuucaggcugcu

SEQ ID NO: 10140 - RNA, 20 nt, Artificial Sequence
  spacer sequence
gaaaucuucaggcugcuuuc

SEQ ID NO: 10141 - RNA, 20 nt, Artificial Sequence
  spacer sequence
gaugauuacaaauuggaguu

SEQ ID NO: 10142 - RNA, 20 nt, Artificial Sequence
  spacer sequence
ucaggcugcuuucaccagaa

SEQ ID NO: 10143 - RNA, 20 nt, Artificial Sequence
  spacer sequence
ggcugcuuucaccagaauuc

SEQ ID NO: 10144 - RNA, 20 nt, Artificial Sequence
  spacer sequence
ccagaauucccaucaaaacu

SEQ ID NO: 10145 - RNA, 20 nt, Artificial Sequence
  spacer sequence
ggugaaagcagccugaagau

SEQ ID NO: 10146 - RNA, 20 nt, Artificial Sequence
  spacer sequence
caucaaaacuagaucuucac

SEQ ID NO: 10147 - RNA, 20 nt, Artificial Sequence
  spacer sequence
aaacuagaucuucacauuga

SEQ ID NO: 10148 - RNA, 20 nt, Artificial Sequence
  spacer sequence
aguuuugaugggaauucugg

SEQ ID NO: 10149 - RNA, 20 nt, Artificial Sequence
  spacer sequence
ucacauugacuuuguguugg

SEQ ID NO: 10150 - RNA, 20 nt, Artificial Sequence
  spacer sequence
cauugacuuuguguugguuu

SEQ ID NO: 10151 - RNA, 20 nt, Artificial Sequence
  spacer sequence
augugaagaucuaguuuuga

SEQ ID NO: 10152 - RNA, 20 nt, Artificial Sequence
  spacer sequence
aacagaccuuucaaccuauu

SEQ ID NO: 10153 - RNA, 20 nt, Artificial Sequence
  spacer sequence
guuagaaaccaacacaaagu

SEQ ID NO: 10154 - RNA, 20 nt, Artificial Sequence
  spacer sequence
accuauuuagcaagucuaga

SEQ ID NO: 10155 - RNA, 20 nt, Artificial Sequence
  spacer sequence
agaagugauuuucugcuauu

SEQ ID NO: 10156 - RNA, 20 nt, Artificial Sequence
  spacer sequence
agacuugcuaaauagguuga

SEQ ID NO: 10157 - RNA, 20 nt, Artificial Sequence
  spacer sequence
cuucuagacuugcuaaauag

SEQ ID NO: 10158 - RNA, 20 nt, Artificial Sequence
  spacer sequence
gcuauuugauguagcuccag

SEQ ID NO: 10159 - RNA, 20 nt, Artificial Sequence
  spacer sequence
aauagcagaaaaucacuucu

SEQ ID NO: 10160 - RNA, 20 nt, Artificial Sequence
  spacer sequence
agcuauuccaaucagcuugu

SEQ ID NO: 10161 - RNA, 20 nt, Artificial Sequence
  spacer sequence
aaucagcuuguaaauuucau

SEQ ID NO: 10162 - RNA, 20 nt, Artificial Sequence
  spacer sequence
gcuuguaaauuucaugaacu

SEQ ID NO: 10163 - RNA, 20 nt, Artificial Sequence
  spacer sequence
ugaacucauuugguaugcuu

SEQ ID NO: 10164 - RNA, 20 nt, Artificial Sequence
  spacer sequence
ugaaauuuacaagcugauug

SEQ ID NO: 10165 - RNA, 20 nt, Artificial Sequence
  spacer sequence
uuugguaugcuuuccuccaa

SEQ ID NO: 10166 - RNA, 20 nt, Artificial Sequence
  spacer sequence
uccaagucaauguuuucuaa

SEQ ID NO: 10167 - RNA, 20 nt, Artificial Sequence
  spacer sequence
aagucaauguuuucuaaaaa

SEQ ID NO: 10168 - RNA, 20 nt, Artificial Sequence
  spacer sequence
auguuuucuaaaaauuaaaa

SEQ ID NO: 10169 - RNA, 20 nt, Artificial Sequence
  spacer sequence
aaaaauuaaaauaggaccua

SEQ ID NO: 10170 - RNA, 20 nt, Artificial Sequence
  spacer sequence
acuuagcaauacugucaucc

SEQ ID NO: 10171 - RNA, 20 nt, Artificial Sequence
  spacer sequence
uccugcccauauuuuucuaa

SEQ ID NO: 10172 - RNA, 20 nt, Artificial Sequence
  spacer sequence
ugcccauauuuuucuaauuc

SEQ ID NO: 10173 - RNA, 20 nt, Artificial Sequence
  spacer sequence
aauucauucauaaugcaauc

SEQ ID NO: 10174 - RNA, 20 nt, Artificial Sequence
  spacer sequence
uucauaaugcaaucauauac

SEQ ID NO: 10175 - RNA, 20 nt, Artificial Sequence
  spacer sequence
uaaugcaaucauauacaaua

SEQ ID NO: 10176 - RNA, 20 nt, Artificial Sequence
  spacer sequence
uauacaauaccuuucugaaa

SEQ ID NO: 10177 - RNA, 20 nt, Artificial Sequence
  spacer sequence
gaaauauuugguauauaguu

SEQ ID NO: 10178 - RNA, 20 nt, Artificial Sequence
  spacer sequence
gaaagguauuguauaugauu

SEQ ID NO: 10179 - RNA, 20 nt, Artificial Sequence
  spacer sequence
cuagacauaacauacuuuac

SEQ ID NO: 10180 - RNA, 20 nt, Artificial Sequence
  spacer sequence
agugaaaacuauauaccaaa

SEQ ID NO: 10181 - RNA, 20 nt, Artificial Sequence
  spacer sequence
guuauaaauuguuagugaau

SEQ ID NO: 10182 - RNA, 20 nt, Artificial Sequence
  spacer sequence
cuaacaauuuauaacagacu

SEQ ID NO: 10183 - RNA, 20 nt, Artificial Sequence
  spacer sequence
guucuggcucuuagugacua

SEQ ID NO: 10184 - RNA, 20 nt, Artificial Sequence
  spacer sequence
ggcucuuagugacuagcaau

SEQ ID NO: 10185 - RNA, 20 nt, Artificial Sequence
  spacer sequence
uagugacuagcaauuucuaa

SEQ ID NO: 10186 - RNA, 20 nt, Artificial Sequence
  spacer sequence
cuaagagccagaacagauuc

SEQ ID NO: 10187 - RNA, 20 nt, Artificial Sequence
  spacer sequence
aaaauuaauaaaaacuggca

SEQ ID NO: 10188 - RNA, 20 nt, Artificial Sequence
  spacer sequence
acaauuucuaaaguaugcuu

SEQ ID NO: 10189 - RNA, 20 nt, Artificial Sequence
  spacer sequence
aaaguaugcuuuuuccuacu

SEQ ID NO: 10190 - RNA, 20 nt, Artificial Sequence
  spacer sequence
uacuuuuugaaauaaaguug

SEQ ID NO: 10191 - RNA, 20 nt, Artificial Sequence
  spacer sequence
aaaaguaggaaaaagcauac

SEQ ID NO: 10192 - RNA, 20 nt, Artificial Sequence
  spacer sequence
gcaacuuuauuucaaaaagu

SEQ ID NO: 10193 - RNA, 20 nt, Artificial Sequence
  spacer sequence
uauugccucggcaacuuuau

SEQ ID NO: 10194 - RNA, 20 nt, Artificial Sequence
  spacer sequence
aauucuuauugccucggcaa

SEQ ID NO: 10195 - RNA, 20 nt, Artificial Sequence
  spacer sequence
ucuaauucuuauugccucgg

SEQ ID NO: 10196 - RNA, 20 nt, Artificial Sequence
  spacer sequence
uauuacuaugugaaguugaa

SEQ ID NO: 10197 - RNA, 20 nt, Artificial Sequence
  spacer sequence
cauaguaauaggagcuuaag

SEQ ID NO: 10198 - RNA, 20 nt, Artificial Sequence
  spacer sequence
acuucacauaguaauaggag

SEQ ID NO: 10199 - RNA, 20 nt, Artificial Sequence
  spacer sequence
uuaaauucaacuucacauag

SEQ ID NO: 10200 - RNA, 20 nt, Artificial Sequence
  spacer sequence
auuuuuucuuuaaauucaac

SEQ ID NO: 10201 - RNA, 20 nt, Artificial Sequence
  spacer sequence
uaaaagaaauacauauauac

SEQ ID NO: 10202 - RNA, 20 nt, Artificial Sequence
  spacer sequence
uuuaggaaacauuucuauuu

SEQ ID NO: 10203 - RNA, 20 nt, Artificial Sequence
  spacer sequence
uugauauauuaaguugagua

SEQ ID NO: 10204 - RNA, 20 nt, Artificial Sequence
  spacer sequence
uaaaccaaauaguuaaaucc

SEQ ID NO: 10205 - RNA, 20 nt, Artificial Sequence
  spacer sequence
aacacaacuuuuauguuuau

SEQ ID NO: 10206 - RNA, 20 nt, Artificial Sequence
  spacer sequence
auguguugcuaauaaacaua

SEQ ID NO: 10207 - RNA, 20 nt, Artificial Sequence
  spacer sequence
uaacaaaagauaauuuuaaa

SEQ ID NO: 10208 - RNA, 20 nt, Artificial Sequence
  spacer sequence
uuuguuaagaaauuuagcgu

SEQ ID NO: 10209 - RNA, 20 nt, Artificial Sequence
  spacer sequence
ucuuuccuguaaagaugcuu

SEQ ID NO: 10210 - RNA, 20 nt, Artificial Sequence
  spacer sequence
uuccuguaaagaugcuuuau

SEQ ID NO: 10211 - RNA, 20 nt, Artificial Sequence
  spacer sequence
uguaaagaugcuuuauccau

SEQ ID NO: 10212 - RNA, 20 nt, Artificial Sequence
  spacer sequence
uuacaggaaagaugauuuua

SEQ ID NO: 10213 - RNA, 20 nt, Artificial Sequence
  spacer sequence
aucuaauuuaaaccugaaga

SEQ ID NO: 10214 - RNA, 20 nt, Artificial Sequence
  spacer sequence
aauuuaaaccugaagacaac

SEQ ID NO: 10215 - RNA, 20 nt, Artificial Sequence
  spacer sequence
gguuuaaauuagauggauaa

SEQ ID NO: 10216 - RNA, 20 nt, Artificial Sequence
  spacer sequence
ucagguuuaaauuagaugga

SEQ ID NO: 10217 - RNA, 20 nt, Artificial Sequence
  spacer sequence
auaaaacacuacugcuagaa

SEQ ID NO: 10218 - RNA, 20 nt, Artificial Sequence
  spacer sequence
ccagcccaguacucuuuuug

SEQ ID NO: 10219 - RNA, 20 nt, Artificial Sequence
  spacer sequence
caccagcccaguacucuuuu

SEQ ID NO: 10220 - RNA, 20 nt, Artificial Sequence
  spacer sequence
aauggacgaguuuuaauucc

SEQ ID NO: 10221 - RNA, 20 nt, Artificial Sequence
  spacer sequence
auuagaucucaccagcccag

SEQ ID NO: 10222 - RNA, 20 nt, Artificial Sequence
  spacer sequence
uccauuagaucucaccagcc

SEQ ID NO: 10223 - RNA, 20 nt, Artificial Sequence
  spacer sequence
gaagagaaauuuaaaacuau

SEQ ID NO: 10224 - RNA, 20 nt, Artificial Sequence
  spacer sequence
gaauuaaaacucguccauua

SEQ ID NO: 10225 - RNA, 20 nt, Artificial Sequence
  spacer sequence
ucggaauuaaaacucgucca

SEQ ID NO: 10226 - RNA, 20 nt, Artificial Sequence
  spacer sequence
cuucggaauuaaaacucguc

SEQ ID NO: 10227 - RNA, 20 nt, Artificial Sequence
  spacer sequence
uguuuuauaguuuuaaauuu

SEQ ID NO: 10228 - RNA, 20 nt, Artificial Sequence
  spacer sequence
auaccuuuugaaccaguaau

SEQ ID NO: 10229 - RNA, 20 nt, Artificial Sequence
  spacer sequence
aauaauugccuuagauaaau

SEQ ID NO: 10230 - RNA, 20 nt, Artificial Sequence
  spacer sequence
caaauuuuccacaauaauua

SEQ ID NO: 10231 - RNA, 20 nt, Artificial Sequence
  spacer sequence
aauuuuccacaauaauuauu

SEQ ID NO: 10232 - RNA, 20 nt, Artificial Sequence
  spacer sequence
acaauaauuauugagaaaau

SEQ ID NO: 10233 - RNA, 20 nt, Artificial Sequence
  spacer sequence
auaauuauuguggaaaauuu

SEQ ID NO: 10234 - RNA, 20 nt, Artificial Sequence
  spacer sequence
caauaauuauuguggaaaau

SEQ ID NO: 10235 - RNA, 20 nt, Artificial Sequence
  spacer sequence
uuuucucaauaauuauugug

SEQ ID NO: 10236 - RNA, 20 nt, Artificial Sequence
  spacer sequence
gucauuuucucaauaauuau

SEQ ID NO: 10237 - RNA, 20 nt, Artificial Sequence
  spacer sequence
cugucauuuucucaauaauu

SEQ ID NO: 10238 - RNA, 20 nt, Artificial Sequence
  spacer sequence
ugcuauuaaaaagaucuggu

SEQ ID NO: 10239 - RNA, 20 nt, Artificial Sequence
  spacer sequence
uuuuaauagcaugaaauucu

SEQ ID NO: 10240 - RNA, 20 nt, Artificial Sequence
  spacer sequence
gguaacuacauaaaaaauuc

SEQ ID NO: 10241 - RNA, 20 nt, Artificial Sequence
  spacer sequence
acuuguguuuggaauuuuuu

SEQ ID NO: 10242 - RNA, 20 nt, Artificial Sequence
  spacer sequence
uccacuuguguuuggaauuu

SEQ ID NO: 10243 - RNA, 20 nt, Artificial Sequence
  spacer sequence
ccuccacuuguguuuggaau

SEQ ID NO: 10244 - RNA, 20 nt, Artificial Sequence
  spacer sequence
uuuuuucuccuccacuugug

SEQ ID NO: 10245 - RNA, 20 nt, Artificial Sequence
  spacer sequence
uuugucuuuuuuucuccucc

SEQ ID NO: 10246 - RNA, 20 nt, Artificial Sequence
  spacer sequence
aaaaugcuaaugguguuuga

SEQ ID NO: 10247 - RNA, 20 nt, Artificial Sequence
  spacer sequence
aacaccauuagcauuuuaga

SEQ ID NO: 10248 - RNA, 20 nt, Artificial Sequence
  spacer sequence
caucaaacaccauuagcauu

SEQ ID NO: 10249 - RNA, 20 nt, Artificial Sequence
  spacer sequence
acuaauucaaauuuaucuaa

SEQ ID NO: 10250 - RNA, 20 nt, Artificial Sequence
  spacer sequence
aauuuaucuaacuugcauua

SEQ ID NO: 10251 - RNA, 20 nt, Artificial Sequence
  spacer sequence
aacuugcauuaauuuuuaaa

SEQ ID NO: 10252 - RNA, 20 nt, Artificial Sequence
  spacer sequence
uuuaaaaauuaaugcaaguu

SEQ ID NO: 10253 - RNA, 20 nt, Artificial Sequence
  spacer sequence
gucugagauacaucuuuguu

SEQ ID NO: 10254 - RNA, 20 nt, Artificial Sequence
  spacer sequence
gagauacaucuuuguucaac

SEQ ID NO: 10255 - RNA, 20 nt, Artificial Sequence
  spacer sequence
gacagauacaaauuaaaguu

SEQ ID NO: 10256 - RNA, 20 nt, Artificial Sequence
  spacer sequence
cagacagauacaaauuaaag

SEQ ID NO: 10257 - RNA, 20 nt, Artificial Sequence
  spacer sequence
uuguucaacuuuugauuaua

SEQ ID NO: 10258 - RNA, 20 nt, Artificial Sequence
  spacer sequence
acuuuugauuauaaauauaa

SEQ ID NO: 10259 - RNA, 20 nt, Artificial Sequence
  spacer sequence
aaaguugaacaaagauguau

SEQ ID NO: 10260 - RNA, 20 nt, Artificial Sequence
  spacer sequence
cuuaguuauauuuauaauca

SEQ ID NO: 10261 - RNA, 20 nt, Artificial Sequence
  spacer sequence
uuaucacuuaguuauauuua

SEQ ID NO: 10262 - RNA, 20 nt, Artificial Sequence
  spacer sequence
guauaaccauauuucuuuau

SEQ ID NO: 10263 - RNA, 20 nt, Artificial Sequence
  spacer sequence
ccauuaucacauaacuuguc

SEQ ID NO: 10264 - RNA, 20 nt, Artificial Sequence
  spacer sequence
cauaacuuguccacagagua

SEQ ID NO: 10265 - RNA, 20 nt, Artificial Sequence
  spacer sequence
ggaguucaagaccagccuga

SEQ ID NO: 10266 - RNA, 20 nt, Artificial Sequence
  spacer sequence
guugcucugcccaccuuggc

SEQ ID NO: 10267 - RNA, 20 nt, Artificial Sequence
  spacer sequence
gcccaccuuggccucccaaa

SEQ ID NO: 10268 - RNA, 20 nt, Artificial Sequence
  spacer sequence
caaagugcugggauuacagg

SEQ ID NO: 10269 - RNA, 20 nt, Artificial Sequence
  spacer sequence
cagcacuuugggaggccaag

SEQ ID NO: 10270 - RNA, 20 nt, Artificial Sequence
  spacer sequence
cgccuguaaucccagcacuu

SEQ ID NO: 10271 - RNA, 20 nt, Artificial Sequence
  spacer sequence
acaucucuucauuaaagaaa

SEQ ID NO: 10272 - RNA, 20 nt, Artificial Sequence
  spacer sequence
cuucauuaaagaaagugucc

SEQ ID NO: 10273 - RNA, 20 nt, Artificial Sequence
  spacer sequence
ucauuaaagaaagugucccu

SEQ ID NO: 10274 - RNA, 20 nt, Artificial Sequence
  spacer sequence
uuaaagaaagugucccuuua

SEQ ID NO: 10275 - RNA, 20 nt, Artificial Sequence
  spacer sequence
uuaaugaagagauguugaaa

SEQ ID NO: 10276 - RNA, 20 nt, Artificial Sequence
  spacer sequence
cuuuaauuauugauauacag

SEQ ID NO: 10277 - RNA, 20 nt, Artificial Sequence
  spacer sequence
auaauuaaagggacacuuuc

SEQ ID NO: 10278 - RNA, 20 nt, Artificial Sequence
  spacer sequence
auauaaauuccacuugcuug

SEQ ID NO: 10279 - RNA, 20 nt, Artificial Sequence
  spacer sequence
acuugcuugucacagacuca

SEQ ID NO: 10280 - RNA, 20 nt, Artificial Sequence
  spacer sequence
cagacucaaaccuuuugaaa

SEQ ID NO: 10281 - RNA, 20 nt, Artificial Sequence
  spacer sequence
gugacaagcaaguggaauuu

SEQ ID NO: 10282 - RNA, 20 nt, Artificial Sequence
  spacer sequence
aaccuuuugaaaccuaaaca

SEQ ID NO: 10283 - RNA, 20 nt, Artificial Sequence
  spacer sequence
aaagguuugagucugugaca

SEQ ID NO: 10284 - RNA, 20 nt, Artificial Sequence
  spacer sequence
acuugcuuagaggaagguau

SEQ ID NO: 10285 - RNA, 20 nt, Artificial Sequence
  spacer sequence
aagcaaguggaaaagugguu

SEQ ID NO: 10286 - RNA, 20 nt, Artificial Sequence
  spacer sequence
ucuaagcaaguggaaaagug

SEQ ID NO: 10287 - RNA, 20 nt, Artificial Sequence
  spacer sequence
uaccuuccucuaagcaagug

SEQ ID NO: 10288 - RNA, 20 nt, Artificial Sequence
  spacer sequence
uguuuucauaccuuccucua

SEQ ID NO: 10289 - RNA, 20 nt, Artificial Sequence
  spacer sequence
ggcauugucaauaugaaaua

SEQ ID NO: 10290 - RNA, 20 nt, Artificial Sequence
  spacer sequence
guuguguuuuuuuuguuuuu

SEQ ID NO: 10291 - RNA, 20 nt, Artificial Sequence
  spacer sequence
ucugcauuauuuuucacucu

SEQ ID NO: 10292 - RNA, 20 nt, Artificial Sequence
  spacer sequence
gcauuauuuuucacucuuua

SEQ ID NO: 10293 - RNA, 20 nt, Artificial Sequence
  spacer sequence
cucuuuaauuguaccaucga

SEQ ID NO: 10294 - RNA, 20 nt, Artificial Sequence
  spacer sequence
uuaauuguaccaucgagccc

SEQ ID NO: 10295 - RNA, 20 nt, Artificial Sequence
  spacer sequence
gggcagaacuaauuuucuaa

SEQ ID NO: 10296 - RNA, 20 nt, Artificial Sequence
  spacer sequence
gcccggaguaaaugguaaua

SEQ ID NO: 10297 - RNA, 20 nt, Artificial Sequence
  spacer sequence
aaguauuaauaguuaauuuc

SEQ ID NO: 10298 - RNA, 20 nt, Artificial Sequence
  spacer sequence
gaaaacuuacucuauaaagc

SEQ ID NO: 10299 - RNA, 20 nt, Artificial Sequence
  spacer sequence
gaaauuaacuauuaauacuu

SEQ ID NO: 10300 - RNA, 20 nt, Artificial Sequence
  spacer sequence
auaaagcauguccuaaugua

SEQ ID NO: 10301 - RNA, 20 nt, Artificial Sequence
  spacer sequence
uaauguauuauuauucuucu

SEQ ID NO: 10302 - RNA, 20 nt, Artificial Sequence
  spacer sequence
ucauuuuacacuaccucccc

SEQ ID NO: 10303 - RNA, 20 nt, Artificial Sequence
  spacer sequence
uuuuacacuaccuccccuac

SEQ ID NO: 10304 - RNA, 20 nt, Artificial Sequence
  spacer sequence
ccuacaauuuccaagggucu

SEQ ID NO: 10305 - RNA, 20 nt, Artificial Sequence
  spacer sequence
aagggucuagccuucacuca

SEQ ID NO: 10306 - RNA, 20 nt, Artificial Sequence
  spacer sequence
agccuucacucaaacuuucc

SEQ ID NO: 10307 - RNA, 20 nt, Artificial Sequence
  spacer sequence
cucaaacuuuccacuuuuag

SEQ ID NO: 10308 - RNA, 20 nt, Artificial Sequence
  spacer sequence
aacuuuccacuuuuagaauc

SEQ ID NO: 10309 - RNA, 20 nt, Artificial Sequence
  spacer sequence
acuuuuagaaucaaggcugu

SEQ ID NO: 10310 - RNA, 20 nt, Artificial Sequence
  spacer sequence
caaaucaauccacaacuucu

SEQ ID NO: 10311 - RNA, 20 nt, Artificial Sequence
  spacer sequence
auccacaacuucuuccuuuu

SEQ ID NO: 10312 - RNA, 20 nt, Artificial Sequence
  spacer sequence
acaacuucuuccuuuucacu

SEQ ID NO: 10313 - RNA, 20 nt, Artificial Sequence
  spacer sequence
uccuuuucacuugcuugaaa

SEQ ID NO: 10314 - RNA, 20 nt, Artificial Sequence
  spacer sequence
uuuucacuugcuugaaagac

SEQ ID NO: 10315 - RNA, 20 nt, Artificial Sequence
  spacer sequence
cuugcuugaaagacaggcca

SEQ ID NO: 10316 - RNA, 20 nt, Artificial Sequence
  spacer sequence
agcaagugaaaaggaagaag

SEQ ID NO: 10317 - RNA, 20 nt, Artificial Sequence
  spacer sequence
uucaagcaagugaaaaggaa

SEQ ID NO: 10318 - RNA, 20 nt, Artificial Sequence
  spacer sequence
uggccugucuuucaagcaag

SEQ ID NO: 10319 - RNA, 20 nt, Artificial Sequence
  spacer sequence
ccuccuggccugucuuucaa

SEQ ID NO: 10320 - RNA, 20 nt, Artificial Sequence
  spacer sequence
uaaaaucaccuccuggccug

SEQ ID NO: 10321 - RNA, 20 nt, Artificial Sequence
  spacer sequence
gcaucacauuuacugugccu

SEQ ID NO: 10322 - RNA, 20 nt, Artificial Sequence
  spacer sequence
cauuuacugugccucacuaa

SEQ ID NO: 10323 - RNA, 20 nt, Artificial Sequence
  spacer sequence
cuaaugaacuucuggucucc

SEQ ID NO: 10324 - RNA, 20 nt, Artificial Sequence
  spacer sequence
uuagugaggcacaguaaaug

SEQ ID NO: 10325 - RNA, 20 nt, Artificial Sequence
  spacer sequence
ggucucccuccccucacagu

SEQ ID NO: 10326 - RNA, 20 nt, Artificial Sequence
  spacer sequence
cccuccccucacaguuggcu

SEQ ID NO: 10327 - RNA, 20 nt, Artificial Sequence
  spacer sequence
cuccccucacaguuggcuau

SEQ ID NO: 10328 - RNA, 20 nt, Artificial Sequence
  spacer sequence
ccucacaguuggcuauuaaa

SEQ ID NO: 10329 - RNA, 20 nt, Artificial Sequence
  spacer sequence
caguuggcuauuaaaacauu

SEQ ID NO: 10330 - RNA, 20 nt, Artificial Sequence
  spacer sequence
uuagccagcaccugguuauu

SEQ ID NO: 10331 - RNA, 20 nt, Artificial Sequence
  spacer sequence
ugcauuugcccauuaaauaa

SEQ ID NO: 10332 - RNA, 20 nt, Artificial Sequence
  spacer sequence
uuucuuguccuucccuuaaa

SEQ ID NO: 10333 - RNA, 20 nt, Artificial Sequence
  spacer sequence
uguccuucccuuaaacuguu

SEQ ID NO: 10334 - RNA, 20 nt, Artificial Sequence
  spacer sequence
uucccuuaaacuguucccac

SEQ ID NO: 10335 - RNA, 20 nt, Artificial Sequence
  spacer sequence
cuuaaacuguucccacugga

SEQ ID NO: 10336 - RNA, 20 nt, Artificial Sequence
  spacer sequence
cacuggauuacuccuuaaaa

SEQ ID NO: 10337 - RNA, 20 nt, Artificial Sequence
  spacer sequence
agugggaacaguuuaaggga

SEQ ID NO: 10338 - RNA, 20 nt, Artificial Sequence
  spacer sequence
uuaaaauaguacgucaaaac

SEQ ID NO: 10339 - RNA, 20 nt, Artificial Sequence
  spacer sequence
aaacuaaaccuauccuuuga

SEQ ID NO: 10340 - RNA, 20 nt, Artificial Sequence
  spacer sequence
uuugaacaaacuuaggauuc

SEQ ID NO: 10341 - RNA, 20 nt, Artificial Sequence
  spacer sequence
aaggauagguuuaguuuuga

SEQ ID NO: 10342 - RNA, 20 nt, Artificial Sequence
  spacer sequence
uaaguuuguucaaaggauag

SEQ ID NO: 10343 - RNA, 20 nt, Artificial Sequence
  spacer sequence
ggaucaacaaaauaauuuac

SEQ ID NO: 10344 - RNA, 20 nt, Artificial Sequence
  spacer sequence
cgaauccuaaguuuguucaa

SEQ ID NO: 10345 - RNA, 20 nt, Artificial Sequence
  spacer sequence
acaaaauaauuuacagagcc

SEQ ID NO: 10346 - RNA, 20 nt, Artificial Sequence
  spacer sequence
guaaauuauuuuguugaucc

SEQ ID NO: 10347 - RNA, 20 nt, Artificial Sequence
  spacer sequence
gcauggcucuguaaauuauu

SEQ ID NO: 10348 - RNA, 20 nt, Artificial Sequence
  spacer sequence
agcggccucugcauggcucu

SEQ ID NO: 10349 - RNA, 20 nt, Artificial Sequence
  spacer sequence
ucuugacagaaaaucagaua

SEQ ID NO: 10350 - RNA, 20 nt, Artificial Sequence
  spacer sequence
uguauggccauuaaaguuua

SEQ ID NO: 10351 - RNA, 20 nt, Artificial Sequence
  spacer sequence
uuaaacuuuaauggccauac

SEQ ID NO: 10352 - RNA, 20 nt, Artificial Sequence
  spacer sequence
uaaaggcuuuaaaacggaua

SEQ ID NO: 10353 - RNA, 20 nt, Artificial Sequence
  spacer sequence
guuuuaaagccuuuaagaaa

SEQ ID NO: 10354 - RNA, 20 nt, Artificial Sequence
  spacer sequence
uuuaagcaggguauuauaau

SEQ ID NO: 10355 - RNA, 20 nt, Artificial Sequence
  spacer sequence
acuuuaacugaaagucaaaa

SEQ ID NO: 10356 - RNA, 20 nt, Artificial Sequence
  spacer sequence
guuaaaguagaauuauaaua

SEQ ID NO: 10357 - RNA, 20 nt, Artificial Sequence
  spacer sequence
aaaggaggaaauauagagga

SEQ ID NO: 10358 - RNA, 20 nt, Artificial Sequence
  spacer sequence
uuuugacuuucaguuaaagu

SEQ ID NO: 10359 - RNA, 20 nt, Artificial Sequence
  spacer sequence
uccuuuugacuuucaguuaa

SEQ ID NO: 10360 - RNA, 20 nt, Artificial Sequence
  spacer sequence
auauuuccuccuuuugacuu

SEQ ID NO: 10361 - RNA, 20 nt, Artificial Sequence
  spacer sequence
ucuauauuuccuccuuuuga

SEQ ID NO: 10362 - RNA, 20 nt, Artificial Sequence
  spacer sequence
ugacagaaugcauuaagaua

SEQ ID NO: 10363 - RNA, 20 nt, Artificial Sequence
  spacer sequence
ugaguguuccucuauauuuc

SEQ ID NO: 10364 - RNA, 20 nt, Artificial Sequence
  spacer sequence
gucaugaguguuccucuaua

SEQ ID NO: 10365 - RNA, 20 nt, Artificial Sequence
  spacer sequence
aagucuugcuguuuuauuua

SEQ ID NO: 10366 - RNA, 20 nt, Artificial Sequence
  spacer sequence
uuuauuaacaucaagcaaga

SEQ ID NO: 10367 - RNA, 20 nt, Artificial Sequence
  spacer sequence
agcaagagcaauucuuuuuu

SEQ ID NO: 10368 - RNA, 20 nt, Artificial Sequence
  spacer sequence
ugcuugauguuaauaaaaga

SEQ ID NO: 10369 - RNA, 20 nt, Artificial Sequence
  spacer sequence
uuuuuuuuuuuuuuuuuuga

SEQ ID NO: 10370 - RNA, 20 nt, Artificial Sequence
  spacer sequence
aaaaaaaaaaaaaaaaaaga

SEQ ID NO: 10371 - RNA, 20 nt, Artificial Sequence
  spacer sequence
caaaaaaaaaaaaaaaaaaa

SEQ ID NO: 10372 - RNA, 20 nt, Artificial Sequence
  spacer sequence
aucucaaaaaaaaaaaaaaa

SEQ ID NO: 10373 - RNA, 20 nt, Artificial Sequence
  spacer sequence
cgcucuguugcccgggcugg

SEQ ID NO: 10374 - RNA, 20 nt, Artificial Sequence
  spacer sequence
cucuguugcccgggcuggag

SEQ ID NO: 10375 - RNA, 20 nt, Artificial Sequence
  spacer sequence
uuaaguuuuaagggguugcu

SEQ ID NO: 10376 - RNA, 20 nt, Artificial Sequence
  spacer sequence
gcaguaaccacagcaacccc

SEQ ID NO: 10377 - RNA, 20 nt, Artificial Sequence
  spacer sequence
aaucugcacauuuuuauuac

SEQ ID NO: 10378 - RNA, 20 nt, Artificial Sequence
  spacer sequence
gcacauuuuuauuacauacc

SEQ ID NO: 10379 - RNA, 20 nt, Artificial Sequence
  spacer sequence
aucuuaauuggaaguuuauu

SEQ ID NO: 10380 - RNA, 20 nt, Artificial Sequence
  spacer sequence
uaauuggaaguuuauuagga

SEQ ID NO: 10381 - RNA, 20 nt, Artificial Sequence
  spacer sequence
aauuaagauggauugcuuau

SEQ ID NO: 10382 - RNA, 20 nt, Artificial Sequence
  spacer sequence
gguuguuuguaaauauuuau

SEQ ID NO: 10383 - RNA, 20 nt, Artificial Sequence
  spacer sequence
gccucaaacaaauauagaga

SEQ ID NO: 10384 - RNA, 20 nt, Artificial Sequence
  spacer sequence
aacaaauauagagauaaaua

SEQ ID NO: 10385 - RNA, 20 nt, Artificial Sequence
  spacer sequence
auauuuguuugaggccgauu

SEQ ID NO: 10386 - RNA, 20 nt, Artificial Sequence
  spacer sequence
cuauauuuguuugaggccga

SEQ ID NO: 10387 - RNA, 20 nt, Artificial Sequence
  spacer sequence
cuuuuaaaguuuuauuuauc

SEQ ID NO: 10388 - RNA, 20 nt, Artificial Sequence
  spacer sequence
ucacuuuuaaaguuuuauuu

SEQ ID NO: 10389 - RNA, 20 nt, Artificial Sequence
  spacer sequence
caggucuucacuuuuaaagu

SEQ ID NO: 10390 - RNA, 20 nt, Artificial Sequence
  spacer sequence
auaauuuuuguucacagguc

SEQ ID NO: 10391 - RNA, 20 nt, Artificial Sequence
  spacer sequence
cuauaauuuuuguucacagg

SEQ ID NO: 10392 - RNA, 20 nt, Artificial Sequence
  spacer sequence
cuaagcaacaaaguacaagg

SEQ ID NO: 10393 - RNA, 20 nt, Artificial Sequence
  spacer sequence
uuguacuuuguugcuuagug

SEQ ID NO: 10394 - RNA, 20 nt, Artificial Sequence
  spacer sequence
ccuaaaaauucaauguaaau

SEQ ID NO: 10395 - RNA, 20 nt, Artificial Sequence
  spacer sequence
guaaaauuuugacugaggca

SEQ ID NO: 10396 - RNA, 20 nt, Artificial Sequence
  spacer sequence
aaauuuuacugaaaugguua

SEQ ID NO: 10397 - RNA, 20 nt, Artificial Sequence
  spacer sequence
gucaaaauuuuacugaaaug

SEQ ID NO: 10398 - RNA, 20 nt, Artificial Sequence
  spacer sequence
aagucauuacacucaagguc

SEQ ID NO: 10399 - RNA, 20 nt, Artificial Sequence
  spacer sequence
uuacacucaaggucgggugu

SEQ ID NO: 10400 - RNA, 20 nt, Artificial Sequence
  spacer sequence
aggucgggugugguggcuca

SEQ ID NO: 10401 - RNA, 20 nt, Artificial Sequence
  spacer sequence
ggugugguggcucacgccug

SEQ ID NO: 10402 - RNA, 20 nt, Artificial Sequence
  spacer sequence
cgccuguaaucccagcacuu

SEQ ID NO: 10403 - RNA, 20 nt, Artificial Sequence
  spacer sequence
cagcacuuugggaggcugag

SEQ ID NO: 10404 - RNA, 20 nt, Artificial Sequence
  spacer sequence
uuauugugacauaucaguau

SEQ ID NO: 10405 - RNA, 20 nt, Artificial Sequence
  spacer sequence
caauaaugaauacaaauguu

SEQ ID NO: 10406 - RNA, 20 nt, Artificial Sequence
  spacer sequence
guaugcagauaaguuuuucc

SEQ ID NO: 10407 - RNA, 20 nt, Artificial Sequence
  spacer sequence
gcauacugauaugucacaau

SEQ ID NO: 10408 - RNA, 20 nt, Artificial Sequence
  spacer sequence
acuauuucaaaaaacauaua

SEQ ID NO: 10409 - RNA, 20 nt, Artificial Sequence
  spacer sequence
aaaaacauauauuaaugcaa

SEQ ID NO: 10410 - RNA, 20 nt, Artificial Sequence
  spacer sequence
ggccauuuccauuacucauu

SEQ ID NO: 10411 - RNA, 20 nt, Artificial Sequence
  spacer sequence
auuacucauuucaugauuau

SEQ ID NO: 10412 - RNA, 20 nt, Artificial Sequence
  spacer sequence
uuucaugauuauuucugaaa

SEQ ID NO: 10413 - RNA, 20 nt, Artificial Sequence
  spacer sequence
ugauuauuucugaaaauaau

SEQ ID NO: 10414 - RNA, 20 nt, Artificial Sequence
  spacer sequence
ugaaaugaguaauggaaaug

SEQ ID NO: 10415 - RNA, 20 nt, Artificial Sequence
  spacer sequence
gaaaauaauuuugcuauaca

SEQ ID NO: 10416 - RNA, 20 nt, Artificial Sequence
  spacer sequence
gaaauaaucaugaaaugagu

SEQ ID NO: 10417 - RNA, 20 nt, Artificial Sequence
  spacer sequence
gcucuggaugucaaauaugc

SEQ ID NO: 10418 - RNA, 20 nt, Artificial Sequence
  spacer sequence
ggaugucaaauaugccagcu

SEQ ID NO: 10419 - RNA, 20 nt, Artificial Sequence
  spacer sequence
agagcagauuuuuuuaaaac

SEQ ID NO: 10420 - RNA, 20 nt, Artificial Sequence
  spacer sequence
aauaugccagcuauaccacu

SEQ ID NO: 10421 - RNA, 20 nt, Artificial Sequence
  spacer sequence
ccggucucuuccaacuggga

SEQ ID NO: 10422 - RNA, 20 nt, Artificial Sequence
  spacer sequence
ggucucuuccaacugggauu

SEQ ID NO: 10423 - RNA, 20 nt, Artificial Sequence
  spacer sequence
cuuccaacugggauuauuga

SEQ ID NO: 10424 - RNA, 20 nt, Artificial Sequence
  spacer sequence
uccaacugggauuauugacc

SEQ ID NO: 10425 - RNA, 20 nt, Artificial Sequence
  spacer sequence
cagcagcacaguauuaauua

SEQ ID NO: 10426 - RNA, 20 nt, Artificial Sequence
  spacer sequence
guguuaauauuaaguguaau

SEQ ID NO: 10427 - RNA, 20 nt, Artificial Sequence
  spacer sequence
acauuucuguguuaauauua

SEQ ID NO: 10428 - RNA, 20 nt, Artificial Sequence
  spacer sequence
cuccuaagcucucaacagau

SEQ ID NO: 10429 - RNA, 20 nt, Artificial Sequence
  spacer sequence
ccuaagcucucaacagaucc

SEQ ID NO: 10430 - RNA, 20 nt, Artificial Sequence
  spacer sequence
uaagcucucaacagauccug

SEQ ID NO: 10431 - RNA, 20 nt, Artificial Sequence
  spacer sequence
caacagauccugguaaggcc

SEQ ID NO: 10432 - RNA, 20 nt, Artificial Sequence
  spacer sequence
acagauccugguaaggccuc

SEQ ID NO: 10433 - RNA, 20 nt, Artificial Sequence
  spacer sequence
guugagagcuuaggagagac

SEQ ID NO: 10434 - RNA, 20 nt, Artificial Sequence
  spacer sequence
ugguaaggccucuucuaacg

SEQ ID NO: 10435 - RNA, 20 nt, Artificial Sequence
  spacer sequence
ugauaagcugaaaacuacac

SEQ ID NO: 10436 - RNA, 20 nt, Artificial Sequence
  spacer sequence
gaagugugcuaaaaaaggau

SEQ ID NO: 10437 - RNA, 20 nt, Artificial Sequence
  spacer sequence
gagcaacagcauacaacuuu

SEQ ID NO: 10438 - RNA, 20 nt, Artificial Sequence
  spacer sequence
uuuuuuagcacacuucagag

SEQ ID NO: 10439 - RNA, 20 nt, Artificial Sequence
  spacer sequence
caacaaauguuaugaauaac

SEQ ID NO: 10440 - RNA, 20 nt, Artificial Sequence
  spacer sequence
acaaauguuaugaauaacac

SEQ ID NO: 10441 - RNA, 20 nt, Artificial Sequence
  spacer sequence
uaacauuuguugagacaaua

SEQ ID NO: 10442 - RNA, 20 nt, Artificial Sequence
  spacer sequence
cuacuauguuaucaaggugu

SEQ ID NO: 10443 - RNA, 20 nt, Artificial Sequence
  spacer sequence
agguguauuucaaaugagau

SEQ ID NO: 10444 - RNA, 20 nt, Artificial Sequence
  spacer sequence
aaugagauuugagugugcgc

SEQ ID NO: 10445 - RNA, 20 nt, Artificial Sequence
  spacer sequence
uuugaaauacaccuugauaa

SEQ ID NO: 10446 - RNA, 20 nt, Artificial Sequence
  spacer sequence
cauuugaaauacaccuugau

SEQ ID NO: 10447 - RNA, 20 nt, Artificial Sequence
  spacer sequence
aaucucauuugaaauacacc

SEQ ID NO: 10448 - RNA, 20 nt, Artificial Sequence
  spacer sequence
gcgcacacucaaaucucauu

SEQ ID NO: 10449 - RNA, 20 nt, Artificial Sequence
  spacer sequence
uguuguaaguauuucccucc

SEQ ID NO: 10450 - RNA, 20 nt, Artificial Sequence
  spacer sequence
gugauaaaccccgcuacaga

SEQ ID NO: 10451 - RNA, 20 nt, Artificial Sequence
  spacer sequence
cugauguucuuguuguaagu

SEQ ID NO: 10452 - RNA, 20 nt, Artificial Sequence
  spacer sequence
guagcgggguuuaucacuga

SEQ ID NO: 10453 - RNA, 20 nt, Artificial Sequence
  spacer sequence
gaagaaucacuuuaucgcaa

SEQ ID NO: 10454 - RNA, 20 nt, Artificial Sequence
  spacer sequence
gagcuuucuguagcgggguu

SEQ ID NO: 10455 - RNA, 20 nt, Artificial Sequence
  spacer sequence
ucagagcuuucuguagcggg

SEQ ID NO: 10456 - RNA, 20 nt, Artificial Sequence
  spacer sequence
cuuuaucgcaaucacuauaa

SEQ ID NO: 10457 - RNA, 20 nt, Artificial Sequence
  spacer sequence
caaucacuauaaagccagac

SEQ ID NO: 10458 - RNA, 20 nt, Artificial Sequence
  spacer sequence
cuauaaagccagaccaauac

SEQ ID NO: 10459 - RNA, 20 nt, Artificial Sequence
  spacer sequence
agaaaguagagaaagaaaac

SEQ ID NO: 10460 - RNA, 20 nt, Artificial Sequence
  spacer sequence
ugacccagggaauucuuagu

SEQ ID NO: 10461 - RNA, 20 nt, Artificial Sequence
  spacer sequence
acuuucuugacccagggaau

SEQ ID NO: 10462 - RNA, 20 nt, Artificial Sequence
  spacer sequence
cuacuuucuugacccaggga

SEQ ID NO: 10463 - RNA, 20 nt, Artificial Sequence
  spacer sequence
uucucuacuuucuugaccca

SEQ ID NO: 10464 - RNA, 20 nt, Artificial Sequence
  spacer sequence
acauucaaaaacuccuggga

SEQ ID NO: 10465 - RNA, 20 nt, Artificial Sequence
  spacer sequence
aaaacuccugggauaacagc

SEQ ID NO: 10466 - RNA, 20 nt, Artificial Sequence
  spacer sequence
ugggauaacagcacaacaug

SEQ ID NO: 10467 - RNA, 20 nt, Artificial Sequence
  spacer sequence
caggaguuuuugaauguuga

SEQ ID NO: 10468 - RNA, 20 nt, Artificial Sequence
  spacer sequence
gagacguuuaucuaaagaca

SEQ ID NO: 10469 - RNA, 20 nt, Artificial Sequence
  spacer sequence
uuucugagacguuuaucuaa

SEQ ID NO: 10470 - RNA, 20 nt, Artificial Sequence
  spacer sequence
aaccccaaacauuaacacua

SEQ ID NO: 10471 - RNA, 20 nt, Artificial Sequence
  spacer sequence
ccaucagaugaacuaaauuc

SEQ ID NO: 10472 - RNA, 20 nt, Artificial Sequence
  spacer sequence
gaugaacuaaauucuagaag

SEQ ID NO: 10473 - RNA, 20 nt, Artificial Sequence
  spacer sequence
gauggggaugccuuauuaag

SEQ ID NO: 10474 - RNA, 20 nt, Artificial Sequence
  spacer sequence
ucugauggggaugccuuauu

SEQ ID NO: 10475 - RNA, 20 nt, Artificial Sequence
  spacer sequence
guugcaguaacacacaucag

SEQ ID NO: 10476 - RNA, 20 nt, Artificial Sequence
  spacer sequence
gucuguugcaguaacacaca

SEQ ID NO: 10477 - RNA, 20 nt, Artificial Sequence
  spacer sequence
uucagucuguugcaguaaca

SEQ ID NO: 10478 - RNA, 20 nt, Artificial Sequence
  spacer sequence
acuuuuucauucagucuguu

SEQ ID NO: 10479 - RNA, 20 nt, Artificial Sequence
  spacer sequence
uuccacuuuuucauucaguc

SEQ ID NO: 10480 - RNA, 20 nt, Artificial Sequence
  spacer sequence
ucauuccacuuuuucauuca

SEQ ID NO: 10481 - RNA, 20 nt, Artificial Sequence
  spacer sequence
agguuuuauuaaaccaaagu

SEQ ID NO: 10482 - RNA, 20 nt, Artificial Sequence
  spacer sequence
uuuaaacuuugguuuaauaa

SEQ ID NO: 10483 - RNA, 20 nt, Artificial Sequence
  spacer sequence
uuuugcauuuuugcacguca

SEQ ID NO: 10484 - RNA, 20 nt, Artificial Sequence
  spacer sequence
cucuuuauuaauuuuuuugu

SEQ ID NO: 10485 - RNA, 20 nt, Artificial Sequence
  spacer sequence
uuauuaauuuuuuuguuuua

SEQ ID NO: 10486 - RNA, 20 nt, Artificial Sequence
  spacer sequence
aaaacaaaaaaauuaauaaa

SEQ ID NO: 10487 - RNA, 20 nt, Artificial Sequence
  spacer sequence
uuaaaaauguuauuuauauu

SEQ ID NO: 10488 - RNA, 20 nt, Artificial Sequence
  spacer sequence
gccaccaugccuggcuaauu

SEQ ID NO: 10489 - RNA, 20 nt, Artificial Sequence
  spacer sequence
cagcuacuugggaggcugag

SEQ ID NO: 10490 - RNA, 20 nt, Artificial Sequence
  spacer sequence
caaguagcugggaccacaaa

SEQ ID NO: 10491 - RNA, 20 nt, Artificial Sequence
  spacer sequence
gccucccaaguagcugggac

SEQ ID NO: 10492 - RNA, 20 nt, Artificial Sequence
  spacer sequence
cagccucccaaguagcuggg

SEQ ID NO: 10493 - RNA, 20 nt, Artificial Sequence
  spacer sequence
ugucucagccucccaaguag

SEQ ID NO: 10494 - RNA, 20 nt, Artificial Sequence
  spacer sequence
uccugucucagccucccaag

SEQ ID NO: 10495 - RNA, 20 nt, Artificial Sequence
  spacer sequence
agccauccuccugucucagc

SEQ ID NO: 10496 - RNA, 20 nt, Artificial Sequence
  spacer sequence
ugggcucaagccauccuccu

SEQ ID NO: 10497 - RNA, 20 nt, Artificial Sequence
  spacer sequence
gccuccugggcucaagccau

SEQ ID NO: 10498 - RNA, 20 nt, Artificial Sequence
  spacer sequence
guggcccagacuagagggca

SEQ ID NO: 10499 - RNA, 20 nt, Artificial Sequence
  spacer sequence
ggcucuguggcccagacuag

SEQ ID NO: 10500 - RNA, 20 nt, Artificial Sequence
  spacer sequence
caaaaaacaaauaaaugggu

SEQ ID NO: 10501 - RNA, 20 nt, Artificial Sequence
  spacer sequence
aaaaacaaauaaaugggucu

SEQ ID NO: 10502 - RNA, 20 nt, Artificial Sequence
  spacer sequence
aaaaccaaaaaguuugagaa

SEQ ID NO: 10503 - RNA, 20 nt, Artificial Sequence
  spacer sequence
aacuuuuugguuuuagaccc

SEQ ID NO: 10504 - RNA, 20 nt, Artificial Sequence
  spacer sequence
caaacuuuuugguuuuagac

SEQ ID NO: 10505 - RNA, 20 nt, Artificial Sequence
  spacer sequence
uacagaaauuccuacacaug

SEQ ID NO: 10506 - RNA, 20 nt, Artificial Sequence
  spacer sequence
guaggacagcuguucucaaa

SEQ ID NO: 10507 - RNA, 20 nt, Artificial Sequence
  spacer sequence
uacacaugcgcaccaggaga

SEQ ID NO: 10508 - RNA, 20 nt, Artificial Sequence
  spacer sequence
uggugcgcauguguaggaau

SEQ ID NO: 10509 - RNA, 20 nt, Artificial Sequence
  spacer sequence
ccuggugcgcauguguagga

SEQ ID NO: 10510 - RNA, 20 nt, Artificial Sequence
  spacer sequence
aacaugucuccuggugcgca

SEQ ID NO: 10511 - RNA, 20 nt, Artificial Sequence
  spacer sequence
uugcagccugucagcaaaau

SEQ ID NO: 10512 - RNA, 20 nt, Artificial Sequence
  spacer sequence
gcaaaauauuaacuaaucuu

SEQ ID NO: 10513 - RNA, 20 nt, Artificial Sequence
  spacer sequence
uaauagacaguauuaauauu

SEQ ID NO: 10514 - RNA, 20 nt, Artificial Sequence
  spacer sequence
gagaauauuauauauuguuu

SEQ ID NO: 10515 - RNA, 20 nt, Artificial Sequence
  spacer sequence
gauacuggaguguaguggca

SEQ ID NO: 10516 - RNA, 20 nt, Artificial Sequence
  spacer sequence
cugauacuggaguguagugg

SEQ ID NO: 10517 - RNA, 20 nt, Artificial Sequence
  spacer sequence
auaaacaauauauaauauuc

SEQ ID NO: 10518 - RNA, 20 nt, Artificial Sequence
  spacer sequence
gugguccauaaacaauauau

SEQ ID NO: 10519 - RNA, 20 nt, Artificial Sequence
  spacer sequence
cugugguccauaaacaauau

SEQ ID NO: 10520 - RNA, 20 nt, Artificial Sequence
  spacer sequence
aauaauuuaguauuaaucuc

SEQ ID NO: 10521 - RNA, 20 nt, Artificial Sequence
  spacer sequence
ccugcaagugggaggagggu

SEQ ID NO: 10522 - RNA, 20 nt, Artificial Sequence
  spacer sequence
ugcaagugggaggaggguug

SEQ ID NO: 10523 - RNA, 20 nt, Artificial Sequence
  spacer sequence
cacuugcaggagaggcaauc

SEQ ID NO: 10524 - RNA, 20 nt, Artificial Sequence
  spacer sequence
ucccacuugcaggagaggca

SEQ ID NO: 10525 - RNA, 20 nt, Artificial Sequence
  spacer sequence
cuccaaccccaacccuccuc

SEQ ID NO: 10526 - RNA, 20 nt, Artificial Sequence
  spacer sequence
ucacuccaaccccaacccuc

SEQ ID NO: 10527 - RNA, 20 nt, Artificial Sequence
  spacer sequence
uccucacuccaaccccaacc

SEQ ID NO: 10528 - RNA, 20 nt, Artificial Sequence
  spacer sequence
uuucauccucacuccaaccc

SEQ ID NO: 10529 - RNA, 20 nt, Artificial Sequence
  spacer sequence
uccuuucauccucacuccaa

SEQ ID NO: 10530 - RNA, 20 nt, Artificial Sequence
  spacer sequence
uaacuguuuuauuuucucug

SEQ ID NO: 10531 - RNA, 20 nt, Artificial Sequence
  spacer sequence
cugcacuauuuuuguacuuu

SEQ ID NO: 10532 - RNA, 20 nt, Artificial Sequence
  spacer sequence
gcacuauuuuuguacuuuuu

SEQ ID NO: 10533 - RNA, 20 nt, Artificial Sequence
  spacer sequence
aggcacgguggcuuacgccu

SEQ ID NO: 10534 - RNA, 20 nt, Artificial Sequence
  spacer sequence
aaugucuuaaaacugcagau

SEQ ID NO: 10535 - RNA, 20 nt, Artificial Sequence
  spacer sequence
uaaaacugcagaugaugcaa

SEQ ID NO: 10536 - RNA, 20 nt, Artificial Sequence
  spacer sequence
gcaguuuuaagacauuugaa

SEQ ID NO: 10537 - RNA, 20 nt, Artificial Sequence
  spacer sequence
ucugcaguuuuaagacauuu

SEQ ID NO: 10538 - RNA, 20 nt, Artificial Sequence
  spacer sequence
cacuuuuuuugcaucaucug

SEQ ID NO: 10539 - RNA, 20 nt, Artificial Sequence
  spacer sequence
ucaggauuuaggcaagaugg

SEQ ID NO: 10540 - RNA, 20 nt, Artificial Sequence
  spacer sequence
ggauuuaggcaagauggguu

SEQ ID NO: 10541 - RNA, 20 nt, Artificial Sequence
  spacer sequence
ugaagaauuguaucuugccc

SEQ ID NO: 10542 - RNA, 20 nt, Artificial Sequence
  spacer sequence
ugccuaaauccugaagaauu

SEQ ID NO: 10543 - RNA, 20 nt, Artificial Sequence
  spacer sequence
uuaacccaucuugccuaaau

SEQ ID NO: 10544 - RNA, 20 nt, Artificial Sequence
  spacer sequence
auggguuaaaaaacacaauc

SEQ ID NO: 10545 - RNA, 20 nt, Artificial Sequence
  spacer sequence
ggcugggcgcaguggcucac

SEQ ID NO: 10546 - RNA, 20 nt, Artificial Sequence
  spacer sequence
cacguguaaucccagcacuu

SEQ ID NO: 10547 - RNA, 20 nt, Artificial Sequence
  spacer sequence
cagcacuuugggaggccagg

SEQ ID NO: 10548 - RNA, 20 nt, Artificial Sequence
  spacer sequence
caaagugcugggauuacacg

SEQ ID NO: 10549 - RNA, 20 nt, Artificial Sequence
  spacer sequence
uggccucccaaagugcuggg

SEQ ID NO: 10550 - RNA, 20 nt, Artificial Sequence
  spacer sequence
acccuccuggccucccaaag

SEQ ID NO: 10551 - RNA, 20 nt, Artificial Sequence
  spacer sequence
cgaggucaagagaucaaguc

SEQ ID NO: 10552 - RNA, 20 nt, Artificial Sequence
  spacer sequence
ugauccacccuccuggccuc

SEQ ID NO: 10553 - RNA, 20 nt, Artificial Sequence
  spacer sequence
agagaucaaguccauccugg

SEQ ID NO: 10554 - RNA, 20 nt, Artificial Sequence
  spacer sequence
ugaccucgugauccacccuc

SEQ ID NO: 10555 - RNA, 20 nt, Artificial Sequence
  spacer sequence
cuugaccucgugauccaccc

SEQ ID NO: 10556 - RNA, 20 nt, Artificial Sequence
  spacer sequence
aguccauccuggccaacaug

SEQ ID NO: 10557 - RNA, 20 nt, Artificial Sequence
  spacer sequence
auccuggccaacauggugaa

SEQ ID NO: 10558 - RNA, 20 nt, Artificial Sequence
  spacer sequence
auacucuuuauucuauucca

SEQ ID NO: 10559 - RNA, 20 nt, Artificial Sequence
  spacer sequence
uuauucuauuccacaaacuu

SEQ ID NO: 10560 - RNA, 20 nt, Artificial Sequence
  spacer sequence
auuccacaaacuuuagcaaa

SEQ ID NO: 10561 - RNA, 20 nt, Artificial Sequence
  spacer sequence
acaaacuuuagcaaauucuu

SEQ ID NO: 10562 - RNA, 20 nt, Artificial Sequence
  spacer sequence
ucacauucagaaguauauaa

SEQ ID NO: 10563 - RNA, 20 nt, Artificial Sequence
  spacer sequence
cauucagaaguauauaaacu

SEQ ID NO: 10564 - RNA, 20 nt, Artificial Sequence
  spacer sequence
gaaguauauaaacuauacaa

SEQ ID NO: 10565 - RNA, 20 nt, Artificial Sequence
  spacer sequence
gaaugugaagaauuugcuaa

SEQ ID NO: 10566 - RNA, 20 nt, Artificial Sequence
  spacer sequence
guuguauaguuuauauacuu

SEQ ID NO: 10567 - RNA, 20 nt, Artificial Sequence
  spacer sequence
ccucuugcugguaaacuaug

SEQ ID NO: 10568 - RNA, 20 nt, Artificial Sequence
  spacer sequence
ugcugguaaacuaugcuauu

SEQ ID NO: 10569 - RNA, 20 nt, Artificial Sequence
  spacer sequence
acacccccuuccuugaaaau

SEQ ID NO: 10570 - RNA, 20 nt, Artificial Sequence
  spacer sequence
uugaaaaugcuaaagccucu

SEQ ID NO: 10571 - RNA, 20 nt, Artificial Sequence
  spacer sequence
aggaaggggguguagaauag

SEQ ID NO: 10572 - RNA, 20 nt, Artificial Sequence
  spacer sequence
acucccaucuaaaagacuag

SEQ ID NO: 10573 - RNA, 20 nt, Artificial Sequence
  spacer sequence
ucggacacaauuaaauugga

SEQ ID NO: 10574 - RNA, 20 nt, Artificial Sequence
  spacer sequence
gacacaauuaaauuggagag

SEQ ID NO: 10575 - RNA, 20 nt, Artificial Sequence
  spacer sequence
gaagauaauauuuuguauag

SEQ ID NO: 10576 - RNA, 20 nt, Artificial Sequence
  spacer sequence
aauuuaauuguguccgaaga

SEQ ID NO: 10577 - RNA, 20 nt, Artificial Sequence
  spacer sequence
ccaauuuaauuguguccgaa

SEQ ID NO: 10578 - RNA, 20 nt, Artificial Sequence
  spacer sequence
cuccaauuuaauuguguccg

SEQ ID NO: 10579 - RNA, 20 nt, Artificial Sequence
  spacer sequence
caauucaaauccuaguucug

SEQ ID NO: 10580 - RNA, 20 nt, Artificial Sequence
  spacer sequence
aauccuaguucugccauuaa

SEQ ID NO: 10581 - RNA, 20 nt, Artificial Sequence
  spacer sequence
uaguucugccauuaacuagc

SEQ ID NO: 10582 - RNA, 20 nt, Artificial Sequence
  spacer sequence
gccauuaacuagcaauaugc

SEQ ID NO: 10583 - RNA, 20 nt, Artificial Sequence
  spacer sequence
ccuaagggcauauugcuagu

SEQ ID NO: 10584 - RNA, 20 nt, Artificial Sequence
  spacer sequence
aaguuuaaguccuauaagcc

SEQ ID NO: 10585 - RNA, 20 nt, Artificial Sequence
  spacer sequence
uauaagcccaacuacuugcc

SEQ ID NO: 10586 - RNA, 20 nt, Artificial Sequence
  spacer sequence
acaugauuguuccacaauua

SEQ ID NO: 10587 - RNA, 20 nt, Artificial Sequence
  spacer sequence
uguggaaauuuuuggcaagu

SEQ ID NO: 10588 - RNA, 20 nt, Artificial Sequence
  spacer sequence
acaauuaaccuguucaaaaa

SEQ ID NO: 10589 - RNA, 20 nt, Artificial Sequence
  spacer sequence
aaaaucaaacacauuuucuu

SEQ ID NO: 10590 - RNA, 20 nt, Artificial Sequence
  spacer sequence
aacacauuuucuucucuacu

SEQ ID NO: 10591 - RNA, 20 nt, Artificial Sequence
  spacer sequence
ucucuacuaaguaggcuuuu

SEQ ID NO: 10592 - RNA, 20 nt, Artificial Sequence
  spacer sequence
cuacuaaguaggcuuuugau

SEQ ID NO: 10593 - RNA, 20 nt, Artificial Sequence
  spacer sequence
acuaaguaggcuuuugauga

SEQ ID NO: 10594 - RNA, 20 nt, Artificial Sequence
  spacer sequence
aaagccuacuuaguagagaa

SEQ ID NO: 10595 - RNA, 20 nt, Artificial Sequence
  spacer sequence
ccacucucucagcccuuagg

SEQ ID NO: 10596 - RNA, 20 nt, Artificial Sequence
  spacer sequence
cucagcccuuaggauguggg

SEQ ID NO: 10597 - RNA, 20 nt, Artificial Sequence
  spacer sequence
cagcccuuaggaugugggga

SEQ ID NO: 10598 - RNA, 20 nt, Artificial Sequence
  spacer sequence
gcccuuaggauguggggaca

SEQ ID NO: 10599 - RNA, 20 nt, Artificial Sequence
  spacer sequence
uaagggcugagagaguggug

SEQ ID NO: 10600 - RNA, 20 nt, Artificial Sequence
  spacer sequence
ccacauccuaagggcugaga

SEQ ID NO: 10601 - RNA, 20 nt, Artificial Sequence
  spacer sequence
gaugccaagguccauggauu

SEQ ID NO: 10602 - RNA, 20 nt, Artificial Sequence
  spacer sequence
gauagguuuauaagcaccuu

SEQ ID NO: 10603 - RNA, 20 nt, Artificial Sequence
  spacer sequence
auggauuccuuuggcccaca

SEQ ID NO: 10604 - RNA, 20 nt, Artificial Sequence
  spacer sequence
uuccauugcaguguggcaua

SEQ ID NO: 10605 - RNA, 20 nt, Artificial Sequence
  spacer sequence
caaaggaagcuguucuaccu

SEQ ID NO: 10606 - RNA, 20 nt, Artificial Sequence
  spacer sequence
uuugggauccuuccauugca

SEQ ID NO: 10607 - RNA, 20 nt, Artificial Sequence
  spacer sequence
accuccuauuaaaauuauuu

SEQ ID NO: 10608 - RNA, 20 nt, Artificial Sequence
  spacer sequence
uauuaaaauuauuugucuaa

SEQ ID NO: 10609 - RNA, 20 nt, Artificial Sequence
  spacer sequence
aagucuuauguccucuauug

SEQ ID NO: 10610 - RNA, 20 nt, Artificial Sequence
  spacer sequence
uauguccucuauuggauuag

SEQ ID NO: 10611 - RNA, 20 nt, Artificial Sequence
  spacer sequence
ucuauuggauuagacuuuua

SEQ ID NO: 10612 - RNA, 20 nt, Artificial Sequence
  spacer sequence
auuggauuagacuuuuaggu

SEQ ID NO: 10613 - RNA, 20 nt, Artificial Sequence
  spacer sequence
aauagaggacauaagacuua

SEQ ID NO: 10614 - RNA, 20 nt, Artificial Sequence
  spacer sequence
aauccaauagaggacauaag

SEQ ID NO: 10615 - RNA, 20 nt, Artificial Sequence
  spacer sequence
ccuaaaagucuaauccaaua

SEQ ID NO: 10616 - RNA, 20 nt, Artificial Sequence
  spacer sequence
gucaccuaaaagucuaaucc

SEQ ID NO: 10617 - RNA, 20 nt, Artificial Sequence
  spacer sequence
uugguagcucuacaguauuc

SEQ ID NO: 10618 - RNA, 20 nt, Artificial Sequence
  spacer sequence
acaguauucaggacauggcu

SEQ ID NO: 10619 - RNA, 20 nt, Artificial Sequence
  spacer sequence
ggacauggcugugcagguga

SEQ ID NO: 10620 - RNA, 20 nt, Artificial Sequence
  spacer sequence
ugaauacuguagagcuacca

SEQ ID NO: 10621 - RNA, 20 nt, Artificial Sequence
  spacer sequence
ccugcacagccauguccuga

SEQ ID NO: 10622 - RNA, 20 nt, Artificial Sequence
  spacer sequence
aaaguuuaagugaagaucag

SEQ ID NO: 10623 - RNA, 20 nt, Artificial Sequence
  spacer sequence
cuuaaacuuuugagugccug

SEQ ID NO: 10624 - RNA, 20 nt, Artificial Sequence
  spacer sequence
ucacuuaaacuuuugagugc

SEQ ID NO: 10625 - RNA, 20 nt, Artificial Sequence
  spacer sequence
gaucucagagauucaagauu

SEQ ID NO: 10626 - RNA, 20 nt, Artificial Sequence
  spacer sequence
gaucuucacuuaaacuuuug

SEQ ID NO: 10627 - RNA, 20 nt, Artificial Sequence
  spacer sequence
cagagauucaagauuauaug

SEQ ID NO: 10628 - RNA, 20 nt, Artificial Sequence
  spacer sequence
gagauucaagauuauauggg

SEQ ID NO: 10629 - RNA, 20 nt, Artificial Sequence
  spacer sequence
gagaucugaucuucacuuaa

SEQ ID NO: 10630 - RNA, 20 nt, Artificial Sequence
  spacer sequence
cugagaucugaucuucacuu

SEQ ID NO: 10631 - RNA, 20 nt, Artificial Sequence
  spacer sequence
agauuauauggggaacgaau

SEQ ID NO: 10632 - RNA, 20 nt, Artificial Sequence
  spacer sequence
ugaaucucugagaucugauc

SEQ ID NO: 10633 - RNA, 20 nt, Artificial Sequence
  spacer sequence
ccauauaaucuugaaucucu

SEQ ID NO: 10634 - RNA, 20 nt, Artificial Sequence
  spacer sequence
uuccccauauaaucuugaau

SEQ ID NO: 10635 - RNA, 20 nt, Artificial Sequence
  spacer sequence
agaacauuucaugaaugggg

SEQ ID NO: 10636 - RNA, 20 nt, Artificial Sequence
  spacer sequence
ugauucguuccccauauaau

SEQ ID NO: 10637 - RNA, 20 nt, Artificial Sequence
  spacer sequence
ugaauggggagaaauaguug

SEQ ID NO: 10638 - RNA, 20 nt, Artificial Sequence
  spacer sequence
ugaaauguucuugauucguu

SEQ ID NO: 10639 - RNA, 20 nt, Artificial Sequence
  spacer sequence
ccauucaugaaauguucuug

SEQ ID NO: 10640 - RNA, 20 nt, Artificial Sequence
  spacer sequence
ccccauucaugaaauguucu

SEQ ID NO: 10641 - RNA, 20 nt, Artificial Sequence
  spacer sequence
acuauuucuccccauucaug

SEQ ID NO: 10642 - RNA, 20 nt, Artificial Sequence
  spacer sequence
caacuauuucuccccauuca

SEQ ID NO: 10643 - RNA, 20 nt, Artificial Sequence
  spacer sequence
aguaggcacaguaagaugaa

SEQ ID NO: 10644 - RNA, 20 nt, Artificial Sequence
  spacer sequence
uacugugccuacuugauuug

SEQ ID NO: 10645 - RNA, 20 nt, Artificial Sequence
  spacer sequence
ucuuacugugccuacuugau

SEQ ID NO: 10646 - RNA, 20 nt, Artificial Sequence
  spacer sequence
gauuaauuucucuagaggag

SEQ ID NO: 10647 - RNA, 20 nt, Artificial Sequence
  spacer sequence
gaguuuaaaauucaucuuac

SEQ ID NO: 10648 - RNA, 20 nt, Artificial Sequence
  spacer sequence
cuagaggaguuuuaauuuag

SEQ ID NO: 10649 - RNA, 20 nt, Artificial Sequence
  spacer sequence
agaggaguuuuaauuuagca

SEQ ID NO: 10650 - RNA, 20 nt, Artificial Sequence
  spacer sequence
agagaaauuaaucugaguuu

SEQ ID NO: 10651 - RNA, 20 nt, Artificial Sequence
  spacer sequence
ucuagagaaauuaaucugag

SEQ ID NO: 10652 - RNA, 20 nt, Artificial Sequence
  spacer sequence
gcuaaauuaaaacuccucua

SEQ ID NO: 10653 - RNA, 20 nt, Artificial Sequence
  spacer sequence
ucugcuaaauuaaaacuccu

SEQ ID NO: 10654 - RNA, 20 nt, Artificial Sequence
  spacer sequence
cuucugcuaaauuaaaacuc

SEQ ID NO: 10655 - RNA, 20 nt, Artificial Sequence
  spacer sequence
uugcaguucauaaagacuag

SEQ ID NO: 10656 - RNA, 20 nt, Artificial Sequence
  spacer sequence
uaaagacuaggaauagaacu

SEQ ID NO: 10657 - RNA, 20 nt, Artificial Sequence
  spacer sequence
uuaugaacugcaaagaaugc

SEQ ID NO: 10658 - RNA, 20 nt, Artificial Sequence
  spacer sequence
uagucuuuaugaacugcaaa

SEQ ID NO: 10659 - RNA, 20 nt, Artificial Sequence
  spacer sequence
auuccuagucuuuaugaacu

SEQ ID NO: 10660 - RNA, 20 nt, Artificial Sequence
  spacer sequence
guucuauuccuagucuuuau

SEQ ID NO: 10661 - RNA, 20 nt, Artificial Sequence
  spacer sequence
uuucaguucuauuccuaguc

SEQ ID NO: 10662 - RNA, 20 nt, Artificial Sequence
  spacer sequence
aguucauuucaguucuauuc

SEQ ID NO: 10663 - RNA, 20 nt, Artificial Sequence
  spacer sequence
uuuuccaguucauuucaguu

SEQ ID NO: 10664 - RNA, 20 nt, Artificial Sequence
  spacer sequence
uuguucauuuuccaguucau

SEQ ID NO: 10665 - RNA, 20 nt, Artificial Sequence
  spacer sequence
uaucauuguucauuuuccag

SEQ ID NO: 10666 - RNA, 20 nt, Artificial Sequence
  spacer sequence
uuuugcacauuuaaaagguc

SEQ ID NO: 10667 - RNA, 20 nt, Artificial Sequence
  spacer sequence
aauaucacuucccuuuuuca

SEQ ID NO: 10668 - RNA, 20 nt, Artificial Sequence
  spacer sequence
cuucccuuuuucaaggaauc

SEQ ID NO: 10669 - RNA, 20 nt, Artificial Sequence
  spacer sequence
cuuuuucaaggaaucaauac

SEQ ID NO: 10670 - RNA, 20 nt, Artificial Sequence
  spacer sequence
aggaaucaauaccauuccua

SEQ ID NO: 10671 - RNA, 20 nt, Artificial Sequence
  spacer sequence
uugaaaaagggaagugauau

SEQ ID NO: 10672 - RNA, 20 nt, Artificial Sequence
  spacer sequence
auaccauuccuaacuuuggu

SEQ ID NO: 10673 - RNA, 20 nt, Artificial Sequence
  spacer sequence
uaacuuugguuuuucaaagu

SEQ ID NO: 10674 - RNA, 20 nt, Artificial Sequence
  spacer sequence
aaguaaaaauuacugauugu

SEQ ID NO: 10675 - RNA, 20 nt, Artificial Sequence
  spacer sequence
guaauuuuuacuuugaaaaa

SEQ ID NO: 10676 - RNA, 20 nt, Artificial Sequence
  spacer sequence
ggauuaauagaaaauacuuu

SEQ ID NO: 10677 - RNA, 20 nt, Artificial Sequence
  spacer sequence
ugaaaaggcacaaucaguaa

SEQ ID NO: 10678 - RNA, 20 nt, Artificial Sequence
  spacer sequence
auuaauccugaaaaggcaca

SEQ ID NO: 10679 - RNA, 20 nt, Artificial Sequence
  spacer sequence
agcacauuguuaagcaaagu

SEQ ID NO: 10680 - RNA, 20 nt, Artificial Sequence
  spacer sequence
acuuccauaaugccugaauc

SEQ ID NO: 10681 - RNA, 20 nt, Artificial Sequence
  spacer sequence
auaaugccugaaucagaaua

SEQ ID NO: 10682 - RNA, 20 nt, Artificial Sequence
  spacer sequence
ggcauuauggaaguugacau

SEQ ID NO: 10683 - RNA, 20 nt, Artificial Sequence
  spacer sequence
gaauacuucugaucuuaaga

SEQ ID NO: 10684 - RNA, 20 nt, Artificial Sequence
  spacer sequence
gauucaggcauuauggaagu

SEQ ID NO: 10685 - RNA, 20 nt, Artificial Sequence
  spacer sequence
gaucuuaagaauaaacuaaa

SEQ ID NO: 10686 - RNA, 20 nt, Artificial Sequence
  spacer sequence
gaaguauucugauucaggca

SEQ ID NO: 10687 - RNA, 20 nt, Artificial Sequence
  spacer sequence
uaagaauaaacuaaaaaucc

SEQ ID NO: 10688 - RNA, 20 nt, Artificial Sequence
  spacer sequence
uaagaucagaaguauucuga

SEQ ID NO: 10689 - RNA, 20 nt, Artificial Sequence
  spacer sequence
ucuucuuucaucaaaaacau

SEQ ID NO: 10690 - RNA, 20 nt, Artificial Sequence
  spacer sequence
ucuuucaucaaaaacauuca

SEQ ID NO: 10691 - RNA, 20 nt, Artificial Sequence
  spacer sequence
uucaucaaaaacauucauuc

SEQ ID NO: 10692 - RNA, 20 nt, Artificial Sequence
  spacer sequence
ucaaaaacauucauucuucc

SEQ ID NO: 10693 - RNA, 20 nt, Artificial Sequence
  spacer sequence
aaaacauucauucuuccgau

SEQ ID NO: 10694 - RNA, 20 nt, Artificial Sequence
  spacer sequence
uucuuccgauucugaaauaa

SEQ ID NO: 10695 - RNA, 20 nt, Artificial Sequence
  spacer sequence
uccgauucugaaauaaauuu

SEQ ID NO: 10696 - RNA, 20 nt, Artificial Sequence
  spacer sequence
gauucugaaauaaauuuuua

SEQ ID NO: 10697 - RNA, 20 nt, Artificial Sequence
  spacer sequence
gaagaaugaauguuuuugau

SEQ ID NO: 10698 - RNA, 20 nt, Artificial Sequence
  spacer sequence
gaaauaaauuuuuaaaauac

SEQ ID NO: 10699 - RNA, 20 nt, Artificial Sequence
  spacer sequence
gaaucggaagaaugaauguu

SEQ ID NO: 10700 - RNA, 20 nt, Artificial Sequence
  spacer sequence
uuguugggagaaaaauguac

SEQ ID NO: 10701 - RNA, 20 nt, Artificial Sequence
  spacer sequence
caacaaugaauguguauuuu

SEQ ID NO: 10702 - RNA, 20 nt, Artificial Sequence
  spacer sequence
cccaacaaugaauguguauu

SEQ ID NO: 10703 - RNA, 20 nt, Artificial Sequence
  spacer sequence
aguacauuuuucucccaaca

SEQ ID NO: 10704 - RNA, 20 nt, Artificial Sequence
  spacer sequence
cauucaacaauuauuugcga

SEQ ID NO: 10705 - RNA, 20 nt, Artificial Sequence
  spacer sequence
uucaacaauuauuugcgagg

SEQ ID NO: 10706 - RNA, 20 nt, Artificial Sequence
  spacer sequence
acaauuauuugcgaggcacc

SEQ ID NO: 10707 - RNA, 20 nt, Artificial Sequence
  spacer sequence
caaauaauuguugaaugaga

SEQ ID NO: 10708 - RNA, 20 nt, Artificial Sequence
  spacer sequence
aaacaggugccucgcaaaua

SEQ ID NO: 10709 - RNA, 20 nt, Artificial Sequence
  spacer sequence
accaaucaaaacaggugccu

SEQ ID NO: 10710 - RNA, 20 nt, Artificial Sequence
  spacer sequence
cuaccaaucaaaacaggugc

SEQ ID NO: 10711 - RNA, 20 nt, Artificial Sequence
  spacer sequence
ccgcuucucuaccaaucaaa

SEQ ID NO: 10712 - RNA, 20 nt, Artificial Sequence
  spacer sequence
uuuccccgcuucucuaccaa

SEQ ID NO: 10713 - RNA, 20 nt, Artificial Sequence
  spacer sequence
guucuuuuccccgcuucucu

SEQ ID NO: 10714 - RNA, 20 nt, Artificial Sequence
  spacer sequence
ugcccucauggagccaggag

SEQ ID NO: 10715 - RNA, 20 nt, Artificial Sequence
  spacer sequence
uggagccaggagccaacaug

SEQ ID NO: 10716 - RNA, 20 nt, Artificial Sequence
  spacer sequence
augagggcaggaaguuucag

SEQ ID NO: 10717 - RNA, 20 nt, Artificial Sequence
  spacer sequence
uggcuccaugagggcaggaa

SEQ ID NO: 10718 - RNA, 20 nt, Artificial Sequence
  spacer sequence
cuggcauguuggcuccuggc

SEQ ID NO: 10719 - RNA, 20 nt, Artificial Sequence
  spacer sequence
accuucagaaaacaaucagc

SEQ ID NO: 10720 - RNA, 20 nt, Artificial Sequence
  spacer sequence
gaaaacaaucagcuuccaac

SEQ ID NO: 10721 - RNA, 20 nt, Artificial Sequence
  spacer sequence
gaagguagaauucacuggca

SEQ ID NO: 10722 - RNA, 20 nt, Artificial Sequence
  spacer sequence
gcuuccaacccugaaauguu

SEQ ID NO: 10723 - RNA, 20 nt, Artificial Sequence
  spacer sequence
aacccugaaauguuuggagc

SEQ ID NO: 10724 - RNA, 20 nt, Artificial Sequence
  spacer sequence
ggguuggaagcugauuguuu

SEQ ID NO: 10725 - RNA, 20 nt, Artificial Sequence
  spacer sequence
aaacauuucaggguuggaag

SEQ ID NO: 10726 - RNA, 20 nt, Artificial Sequence
  spacer sequence
caaauucucuggcgaucaaa

SEQ ID NO: 10727 - RNA, 20 nt, Artificial Sequence
  spacer sequence
cuggcgaucaaaaacuagga

SEQ ID NO: 10728 - RNA, 20 nt, Artificial Sequence
  spacer sequence
ggcgaucaaaaacuaggaca

SEQ ID NO: 10729 - RNA, 20 nt, Artificial Sequence
  spacer sequence
ccagagaauuugugauaaug

SEQ ID NO: 10730 - RNA, 20 nt, Artificial Sequence
  spacer sequence
aaaacuaggacauauuauuu

SEQ ID NO: 10731 - RNA, 20 nt, Artificial Sequence
  spacer sequence
uaguuuuugaucgccagaga

SEQ ID NO: 10732 - RNA, 20 nt, Artificial Sequence
  spacer sequence
aaacaauaaaaauaauaugu

SEQ ID NO: 10733 - RNA, 20 nt, Artificial Sequence
  spacer sequence
ucacaacugaacuuuuacaa

SEQ ID NO: 10734 - RNA, 20 nt, Artificial Sequence
  spacer sequence
caacugaacuuuuacaagac

SEQ ID NO: 10735 - RNA, 20 nt, Artificial Sequence
  spacer sequence
guugugaugauuuucaaaac

SEQ ID NO: 10736 - RNA, 20 nt, Artificial Sequence
  spacer sequence
uguaaaaguucaguugugau

SEQ ID NO: 10737 - RNA, 20 nt, Artificial Sequence
  spacer sequence
aauaccaguugcaacuucug

SEQ ID NO: 10738 - RNA, 20 nt, Artificial Sequence
  spacer sequence
gcaguuagggcauuuuaugu

SEQ ID NO: 10739 - RNA, 20 nt, Artificial Sequence
  spacer sequence
auugaagaaaaucacuuuua

SEQ ID NO: 10740 - RNA, 20 nt, Artificial Sequence
  spacer sequence
auugauggguacauaaaaug

SEQ ID NO: 10741 - RNA, 20 nt, Artificial Sequence
  spacer sequence
ucaauugauggguacauaaa

SEQ ID NO: 10742 - RNA, 20 nt, Artificial Sequence
  spacer sequence
cuuuuaggauaauuuauaug

SEQ ID NO: 10743 - RNA, 20 nt, Artificial Sequence
  spacer sequence
uaaaagugauuuucuucaau

SEQ ID NO: 10744 - RNA, 20 nt, Artificial Sequence
  spacer sequence
caacugcaguguaauuggaa

SEQ ID NO: 10745 - RNA, 20 nt, Artificial Sequence
  spacer sequence
acugcaguguaauuggaaag

SEQ ID NO: 10746 - RNA, 20 nt, Artificial Sequence
  spacer sequence
aauuacacugcaguugagac

SEQ ID NO: 10747 - RNA, 20 nt, Artificial Sequence
  spacer sequence
cauauauuauggcacugcaa

SEQ ID NO: 10748 - RNA, 20 nt, Artificial Sequence
  spacer sequence
aaaggaaaguuauugcacca

SEQ ID NO: 10749 - RNA, 20 nt, Artificial Sequence
  spacer sequence
uuuagauuugcagugccaua

SEQ ID NO: 10750 - RNA, 20 nt, Artificial Sequence
  spacer sequence
gugagaugcagcacguuuuu

SEQ ID NO: 10751 - RNA, 20 nt, Artificial Sequence
  spacer sequence
cagauuuuguagguuuacuu

SEQ ID NO: 10752 - RNA, 20 nt, Artificial Sequence
  spacer sequence
cacagauuuuguagguuuac

SEQ ID NO: 10753 - RNA, 20 nt, Artificial Sequence
  spacer sequence
acacaucucgaacuacaaca

SEQ ID NO: 10754 - RNA, 20 nt, Artificial Sequence
  spacer sequence
cgaacuacaacauuugauuu

SEQ ID NO: 10755 - RNA, 20 nt, Artificial Sequence
  spacer sequence
aacuacaacauuugauuuuu

SEQ ID NO: 10756 - RNA, 20 nt, Artificial Sequence
  spacer sequence
agauguguggauguggcguu

SEQ ID NO: 10757 - RNA, 20 nt, Artificial Sequence
  spacer sequence
aauguuguaguucgagaugu

SEQ ID NO: 10758 - RNA, 20 nt, Artificial Sequence
  spacer sequence
auguugcuuuaucuuuggua

SEQ ID NO: 10759 - RNA, 20 nt, Artificial Sequence
  spacer sequence
uugguauuuggaaagggaag

SEQ ID NO: 10760 - RNA, 20 nt, Artificial Sequence
  spacer sequence
aaauaccaaagauaaagcaa

SEQ ID NO: 10761 - RNA, 20 nt, Artificial Sequence
  spacer sequence
cuuuccaaauaccaaagaua

SEQ ID NO: 10762 - RNA, 20 nt, Artificial Sequence
  spacer sequence
ucccuuuccaaauaccaaag

SEQ ID NO: 10763 - RNA, 20 nt, Artificial Sequence
  spacer sequence
acccaugacaauaguuccca

SEQ ID NO: 10764 - RNA, 20 nt, Artificial Sequence
  spacer sequence
uggguugaguuguauugucu

SEQ ID NO: 10765 - RNA, 20 nt, Artificial Sequence
  spacer sequence
cauucuguaacugcauuuua

SEQ ID NO: 10766 - RNA, 20 nt, Artificial Sequence
  spacer sequence
guaacugcauuuuaaaucau

SEQ ID NO: 10767 - RNA, 20 nt, Artificial Sequence
  spacer sequence
ucaauggucaagucuccucc

SEQ ID NO: 10768 - RNA, 20 nt, Artificial Sequence
  spacer sequence
auggucaagucuccuccucc

SEQ ID NO: 10769 - RNA, 20 nt, Artificial Sequence
  spacer sequence
agucuccuccucccaaaucg

SEQ ID NO: 10770 - RNA, 20 nt, Artificial Sequence
  spacer sequence
ccuccucccaaaucgauucu

SEQ ID NO: 10771 - RNA, 20 nt, Artificial Sequence
  spacer sequence
uccucccaaaucgauucuga

SEQ ID NO: 10772 - RNA, 20 nt, Artificial Sequence
  spacer sequence
ucccaaaucgauucugacaa

SEQ ID NO: 10773 - RNA, 20 nt, Artificial Sequence
  spacer sequence
caaaucgauucugacaaaua

SEQ ID NO: 10774 - RNA, 20 nt, Artificial Sequence
  spacer sequence
auucugacaaauaggaugua

SEQ ID NO: 10775 - RNA, 20 nt, Artificial Sequence
  spacer sequence
auuugggaggaggagacuug

SEQ ID NO: 10776 - RNA, 20 nt, Artificial Sequence
  spacer sequence
gacaaauaggauguauggac

SEQ ID NO: 10777 - RNA, 20 nt, Artificial Sequence
  spacer sequence
gaaucgauuugggaggagga

SEQ ID NO: 10778 - RNA, 20 nt, Artificial Sequence
  spacer sequence
uauuugucagaaucgauuug

SEQ ID NO: 10779 - RNA, 20 nt, Artificial Sequence
  spacer sequence
auacauccuauuugucagaa

SEQ ID NO: 10780 - RNA, 20 nt, Artificial Sequence
  spacer sequence
acacuccaaaagcaacaccu

SEQ ID NO: 10781 - RNA, 20 nt, Artificial Sequence
  spacer sequence
aaaagcaacaccuggaauga

SEQ ID NO: 10782 - RNA, 20 nt, Artificial Sequence
  spacer sequence
agguguugcuuuuggagugu

SEQ ID NO: 10783 - RNA, 20 nt, Artificial Sequence
  spacer sequence
uuccagguguugcuuuugga

SEQ ID NO: 10784 - RNA, 20 nt, Artificial Sequence
  spacer sequence
gagaaacaacuagagaacuu

SEQ ID NO: 10785 - RNA, 20 nt, Artificial Sequence
  spacer sequence
gaucauuccagguguugcuu

SEQ ID NO: 10786 - RNA, 20 nt, Artificial Sequence
  spacer sequence
cugaucauuccagguguugc

SEQ ID NO: 10787 - RNA, 20 nt, Artificial Sequence
  spacer sequence
aguuguuucucugaucauuc

SEQ ID NO: 10788 - RNA, 20 nt, Artificial Sequence
  spacer sequence
cuaguuguuucucugaucau

SEQ ID NO: 10789 - RNA, 20 nt, Artificial Sequence
  spacer sequence
caguuuggagagguuuucac

SEQ ID NO: 10790 - RNA, 20 nt, Artificial Sequence
  spacer sequence
aaacugggaacaaagcugcc

SEQ ID NO: 10791 - RNA, 20 nt, Artificial Sequence
  spacer sequence
ccaaacugggaacaaagcug

SEQ ID NO: 10792 - RNA, 20 nt, Artificial Sequence
  spacer sequence
cauguaaauguccucguaga

SEQ ID NO: 10793 - RNA, 20 nt, Artificial Sequence
  spacer sequence
ucguagaagggagccgagga

SEQ ID NO: 10794 - RNA, 20 nt, Artificial Sequence
  spacer sequence
uagaagggagccgaggauua

SEQ ID NO: 10795 - RNA, 20 nt, Artificial Sequence
  spacer sequence
acgaggacauuuacauguga

SEQ ID NO: 10796 - RNA, 20 nt, Artificial Sequence
  spacer sequence
cuucuacgaggacauuuaca

SEQ ID NO: 10797 - RNA, 20 nt, Artificial Sequence
  spacer sequence
gcucccuucuacgaggacau

SEQ ID NO: 10798 - RNA, 20 nt, Artificial Sequence
  spacer sequence
ucggcucccuucuacgagga

SEQ ID NO: 10799 - RNA, 20 nt, Artificial Sequence
  spacer sequence
ggagggggugcgaggguagg

SEQ ID NO: 10800 - RNA, 20 nt, Artificial Sequence
  spacer sequence
cgagguaguuaauccucggc

SEQ ID NO: 10801 - RNA, 20 nt, Artificial Sequence
  spacer sequence
cacccccucccgagguaguu

SEQ ID NO: 10802 - RNA, 20 nt, Artificial Sequence
  spacer sequence
cuacccucgcacccccuccc

SEQ ID NO: 10803 - RNA, 20 nt, Artificial Sequence
  spacer sequence
aguucccuacccucgcaccc

SEQ ID NO: 10804 - RNA, 20 nt, Artificial Sequence
  spacer sequence
uccaguucccuacccucgca

SEQ ID NO: 10805 - RNA, 20 nt, Artificial Sequence
  spacer sequence
agcggacuaaggcggagcga

SEQ ID NO: 10806 - RNA, 20 nt, Artificial Sequence
  spacer sequence
gcuagaaagcuggcguuguc

SEQ ID NO: 10807 - RNA, 20 nt, Artificial Sequence
  spacer sequence
gccuuaguccgcuagaaagc

SEQ ID NO: 10808 - RNA, 20 nt, Artificial Sequence
  spacer sequence
cuccgccuuaguccgcuaga

SEQ ID NO: 10809 - RNA, 20 nt, Artificial Sequence
  spacer sequence
ucucucccauucaacuuuuu

SEQ ID NO: 10810 - RNA, 20 nt, Artificial Sequence
  spacer sequence
cucccauucaacuuuuuagg

SEQ ID NO: 10811 - RNA, 20 nt, Artificial Sequence
  spacer sequence
cccauucaacuuuuuaggcg

SEQ ID NO: 10812 - RNA, 20 nt, Artificial Sequence
  spacer sequence
cauucaacuuuuuaggcguc

SEQ ID NO: 10813 - RNA, 20 nt, Artificial Sequence
  spacer sequence
acuuuuuaggcgucacguug

SEQ ID NO: 10814 - RNA, 20 nt, Artificial Sequence
  spacer sequence
cguuggggccauagagccua

SEQ ID NO: 10815 - RNA, 20 nt, Artificial Sequence
  spacer sequence
auggccccaacgugacgccu

SEQ ID NO: 10816 - RNA, 20 nt, Artificial Sequence
  spacer sequence
uauaggcucuauggccccaa

SEQ ID NO: 10817 - RNA, 20 nt, Artificial Sequence
  spacer sequence
cgacuuuaaauuauaacgag

SEQ ID NO: 10818 - RNA, 20 nt, Artificial Sequence
  spacer sequence
ugaacauaacccucuuauag

SEQ ID NO: 10819 - RNA, 20 nt, Artificial Sequence
  spacer sequence
uuauaauuuaaagucgugaa

SEQ ID NO: 10820 - RNA, 20 nt, Artificial Sequence
  spacer sequence
ccguuuauuagcccuauuuc

SEQ ID NO: 10821 - RNA, 20 nt, Artificial Sequence
  spacer sequence
guuuauuagcccuauuuccc

SEQ ID NO: 10822 - RNA, 20 nt, Artificial Sequence
  spacer sequence
caagugcgugaaucccggag

SEQ ID NO: 10823 - RNA, 20 nt, Artificial Sequence
  spacer sequence
cgcacuugggaaauagggcu

SEQ ID NO: 10824 - RNA, 20 nt, Artificial Sequence
  spacer sequence
cggagaagggggaugaacac

SEQ ID NO: 10825 - RNA, 20 nt, Artificial Sequence
  spacer sequence
gggauucacgcacuugggaa

SEQ ID NO: 10826 - RNA, 20 nt, Artificial Sequence
  spacer sequence
ccgggauucacgcacuuggg

SEQ ID NO: 10827 - RNA, 20 nt, Artificial Sequence
  spacer sequence
cccuucuccgggauucacgc

SEQ ID NO: 10828 - RNA, 20 nt, Artificial Sequence
  spacer sequence
ucccccuucuccgggauuca

SEQ ID NO: 10829 - RNA, 20 nt, Artificial Sequence
  spacer sequence
ucaacuccucccagacccgg

SEQ ID NO: 10830 - RNA, 20 nt, Artificial Sequence
  spacer sequence
acuccucccagacccgggau

SEQ ID NO: 10831 - RNA, 20 nt, Artificial Sequence
  spacer sequence
ucccagacccgggaucagag

SEQ ID NO: 10832 - RNA, 20 nt, Artificial Sequence
  spacer sequence
cagacccgggaucagagucc

SEQ ID NO: 10833 - RNA, 20 nt, Artificial Sequence
  spacer sequence
gggaggaguugaagagggug

SEQ ID NO: 10834 - RNA, 20 nt, Artificial Sequence
  spacer sequence
cgggucugggaggaguugaa

SEQ ID NO: 10835 - RNA, 20 nt, Artificial Sequence
  spacer sequence
gaguccagccgucgacgcgc

SEQ ID NO: 10836 - RNA, 20 nt, Artificial Sequence
  spacer sequence
gaucccgggucugggaggag

SEQ ID NO: 10837 - RNA, 20 nt, Artificial Sequence
  spacer sequence
agccgucgacgcgccgcggc

SEQ ID NO: 10838 - RNA, 20 nt, Artificial Sequence
  spacer sequence
acgcgccgcggccugagcaa

SEQ ID NO: 10839 - RNA, 20 nt, Artificial Sequence
  spacer sequence
acggcuggacucugaucccg

SEQ ID NO: 10840 - RNA, 20 nt, Artificial Sequence
  spacer sequence
ggccgcggcgcgucgacggc

SEQ ID NO: 10841 - RNA, 20 nt, Artificial Sequence
  spacer sequence
uguugcucaggccgcggcgc

SEQ ID NO: 10842 - RNA, 20 nt, Artificial Sequence
  spacer sequence
ccuguugcucaggccgcggc

SEQ ID NO: 10843 - RNA, 20 nt, Artificial Sequence
  spacer sequence
gcucuccuguugcucaggcc

SEQ ID NO: 10844 - RNA, 20 nt, Artificial Sequence
  spacer sequence
ccgccagccccacgaccggc

SEQ ID NO: 10845 - RNA, 20 nt, Artificial Sequence
  spacer sequence
gccagccccacgaccggcag

SEQ ID NO: 10846 - RNA, 20 nt, Artificial Sequence
  spacer sequence
uggggcuggcggagaggugg

SEQ ID NO: 10847 - RNA, 20 nt, Artificial Sequence
  spacer sequence
gccggucguggggcuggcgg

SEQ ID NO: 10848 - RNA, 20 nt, Artificial Sequence
  spacer sequence
cgcucccccgcccccaaccc

SEQ ID NO: 10849 - RNA, 20 nt, Artificial Sequence
  spacer sequence
cccgcccccaaccccacacg

SEQ ID NO: 10850 - RNA, 20 nt, Artificial Sequence
  spacer sequence
uucuuagcccuuugcgggcu

SEQ ID NO: 10851 - RNA, 20 nt, Artificial Sequence
  spacer sequence
uagcccuuugcgggcucccg

SEQ ID NO: 10852 - RNA, 20 nt, Artificial Sequence
  spacer sequence
cggcacugcgaacccgacaa

SEQ ID NO: 10853 - RNA, 20 nt, Artificial Sequence
  spacer sequence
cagugccgggagcccgcaaa

SEQ ID NO: 10854 - RNA, 20 nt, Artificial Sequence
  spacer sequence
gguucgcagugccgggagcc

SEQ ID NO: 10855 - RNA, 20 nt, Artificial Sequence
  spacer sequence
cggagcagagagcgagggcg

SEQ ID NO: 10856 - RNA, 20 nt, Artificial Sequence
  spacer sequence
gcgagccccguugucggguu

SEQ ID NO: 10857 - RNA, 20 nt, Artificial Sequence
  spacer sequence
gcuccgcgagccccguuguc

SEQ ID NO: 10858 - RNA, 20 nt, Artificial Sequence
  spacer sequence
cugcuccgcgagccccguug

SEQ ID NO: 10859 - RNA, 20 nt, Artificial Sequence
  spacer sequence
cucucugcuccgcgagcccc

SEQ ID NO: 10860 - RNA, 20 nt, Artificial Sequence
  spacer sequence
gggcgcccucgcucucugcu

SEQ ID NO: 10861 - RNA, 20 nt, Artificial Sequence
  spacer sequence
ggucugggcgcccucgcucu

SEQ ID NO: 10862 - RNA, 20 nt, Artificial Sequence
  spacer sequence
aacuuggcccuuuuucgggu

SEQ ID NO: 10863 - RNA, 20 nt, Artificial Sequence
  spacer sequence
ucuaacuuggcccuuuuucg

SEQ ID NO: 10864 - RNA, 20 nt, Artificial Sequence
  spacer sequence
gugccuguuccucuaacuug

SEQ ID NO: 10865 - RNA, 20 nt, Artificial Sequence
  spacer sequence
cauagcccaagucugugccu

SEQ ID NO: 10866 - RNA, 20 nt, Artificial Sequence
  spacer sequence
cccccuugcggccucccaua

SEQ ID NO: 10867 - RNA, 20 nt, Artificial Sequence
  spacer sequence
ccucgcccccuugcggccuc

SEQ ID NO: 10868 - RNA, 20 nt, Artificial Sequence
  spacer sequence
ccccucgcccccuugcggcc

SEQ ID NO: 10869 - RNA, 20 nt, Artificial Sequence
  spacer sequence
ggcuucuccccucgcccccu

SEQ ID NO: 10870 - RNA, 20 nt, Artificial Sequence
  spacer sequence
cgguccgggggugggcagug

SEQ ID NO: 10871 - RNA, 20 nt, Artificial Sequence
  spacer sequence
gggggugggcagugggggga

SEQ ID NO: 10872 - RNA, 20 nt, Artificial Sequence
  spacer sequence
ccccacugcccacccccgga

SEQ ID NO: 10873 - RNA, 20 nt, Artificial Sequence
  spacer sequence
guucccguggucgccgcgac

SEQ ID NO: 10874 - RNA, 20 nt, Artificial Sequence
  spacer sequence
cguggucgccgcgaccucuc

SEQ ID NO: 10875 - RNA, 20 nt, Artificial Sequence
  spacer sequence
ccgcgaccucucccgggcca

SEQ ID NO: 10876 - RNA, 20 nt, Artificial Sequence
  spacer sequence
cggcgaccacgggaacugac

SEQ ID NO: 10877 - RNA, 20 nt, Artificial Sequence
  spacer sequence
cccgggccacaggccccgcu

SEQ ID NO: 10878 - RNA, 20 nt, Artificial Sequence
  spacer sequence
cgggccacaggccccgcucc

SEQ ID NO: 10879 - RNA, 20 nt, Artificial Sequence
  spacer sequence
gcgcaggccccgccgccccg

SEQ ID NO: 10880 - RNA, 20 nt, Artificial Sequence
  spacer sequence
ggggcggcggggccugcgcg

SEQ ID NO: 10881 - RNA, 20 nt, Artificial Sequence
  spacer sequence
ugccccgguuccggggcggc

SEQ ID NO: 10882 - RNA, 20 nt, Artificial Sequence
  spacer sequence
ccacccggaccaaagcuuua

SEQ ID NO: 10883 - RNA, 20 nt, Artificial Sequence
  spacer sequence
ggguggggacgcuuccugcc

SEQ ID NO: 10884 - RNA, 20 nt, Artificial Sequence
  spacer sequence
ggcggcgggagaaacgagcc

SEQ ID NO: 10885 - RNA, 20 nt, Artificial Sequence
  spacer sequence
cgccgccggagguuuaaagc

SEQ ID NO: 10886 - RNA, 20 nt, Artificial Sequence
  spacer sequence
cccgccgccggagguuuaaa

SEQ ID NO: 10887 - RNA, 20 nt, Artificial Sequence
  spacer sequence
uuucucccgccgccggaggu

SEQ ID NO: 10888 - RNA, 20 nt, Artificial Sequence
  spacer sequence
cgcagcaggcccggcacccc

SEQ ID NO: 10889 - RNA, 20 nt, Artificial Sequence
  spacer sequence
ugguugaaggcguugacggc

SEQ ID NO: 10890 - RNA, 20 nt, Artificial Sequence
  spacer sequence
accaggagguaagggguguu

SEQ ID NO: 10891 - RNA, 20 nt, Artificial Sequence
  spacer sequence
acgccuucaaccaggaggua

SEQ ID NO: 10892 - RNA, 20 nt, Artificial Sequence
  spacer sequence
auguucgcgcugcggcggcg

SEQ ID NO: 10893 - RNA, 20 nt, Artificial Sequence
  spacer sequence
cgcugcggcggcggcugcuc

SEQ ID NO: 10894 - RNA, 20 nt, Artificial Sequence
  spacer sequence
gggcccgccggucacauaga

SEQ ID NO: 10895 - RNA, 20 nt, Artificial Sequence
  spacer sequence
cauagaccucgcgccgcggc

SEQ ID NO: 10896 - RNA, 20 nt, Artificial Sequence
  spacer sequence
augugaccggcgggcccgga

SEQ ID NO: 10897 - RNA, 20 nt, Artificial Sequence
  spacer sequence
cgccgcggcggagcggggcu

SEQ ID NO: 10898 - RNA, 20 nt, Artificial Sequence
  spacer sequence
gccgcggcgcgaggucuaug

SEQ ID NO: 10899 - RNA, 20 nt, Artificial Sequence
  spacer sequence
cagccccgcuccgccgcggc

SEQ ID NO: 10900 - RNA, 20 nt, Artificial Sequence
  spacer sequence
ccccggccaccaggcccggc

SEQ ID NO: 10901 - RNA, 20 nt, Artificial Sequence
  spacer sequence
ccuccccccggccaccaggc

SEQ ID NO: 10902 - RNA, 20 nt, Artificial Sequence
  spacer sequence
ucgccuccccccggccacca

SEQ ID NO: 10903 - RNA, 20 nt, Artificial Sequence
  spacer sequence
gccgcucgucgccucccccc

SEQ ID NO: 10904 - RNA, 20 nt, Artificial Sequence
  spacer sequence
gaggcccgggcaggaagagg

SEQ ID NO: 10905 - RNA, 20 nt, Artificial Sequence
  spacer sequence
gacuccgccgcucgucgccu

SEQ ID NO: 10906 - RNA, 20 nt, Artificial Sequence
  spacer sequence
ugcccgggccucggacuccg

SEQ ID NO: 10907 - RNA, 20 nt, Artificial Sequence
  spacer sequence
uccugcccgggccucggacu

SEQ ID NO: 10908 - RNA, 20 nt, Artificial Sequence
  spacer sequence
ggcgcagccucuuccugccc

SEQ ID NO: 10909 - RNA, 20 nt, Artificial Sequence
  spacer sequence
ccgcuucgggcgcagccucu

SEQ ID NO: 10910 - RNA, 20 nt, Artificial Sequence
  spacer sequence
gccgcccgccucgccgcuuc

SEQ ID NO: 10911 - RNA, 20 nt, Artificial Sequence
  spacer sequence
gccucggccgcccgccucgc

SEQ ID NO: 10912 - RNA, 20 nt, Artificial Sequence
  spacer sequence
gccucugccucggccgcccg

SEQ ID NO: 10913 - RNA, 20 nt, Artificial Sequence
  spacer sequence
ccgccucugccucggccgcc

SEQ ID NO: 10914 - RNA, 20 nt, Artificial Sequence
  spacer sequence
cagucccguucgcaggauga

SEQ ID NO: 10915 - RNA, 20 nt, Artificial Sequence
  spacer sequence
gucccguucgcaggaugagg

SEQ ID NO: 10916 - RNA, 20 nt, Artificial Sequence
  spacer sequence
cguucgcaggaugaggaaaa

SEQ ID NO: 10917 - RNA, 20 nt, Artificial Sequence
  spacer sequence
caggaugaggaaaaggaggc

SEQ ID NO: 10918 - RNA, 20 nt, Artificial Sequence
  spacer sequence
ugcgaacgggacugagaggg

SEQ ID NO: 10919 - RNA, 20 nt, Artificial Sequence
  spacer sequence
uccugcgaacgggacugaga

SEQ ID NO: 10920 - RNA, 20 nt, Artificial Sequence
  spacer sequence
ucauccugcgaacgggacug

SEQ ID NO: 10921 - RNA, 20 nt, Artificial Sequence
  spacer sequence
uuuuccucauccugcgaacg

SEQ ID NO: 10922 - RNA, 20 nt, Artificial Sequence
  spacer sequence
ucaacauguccguuuggugg

SEQ ID NO: 10923 - RNA, 20 nt, Artificial Sequence
  spacer sequence
acauguccguuugguggugg

SEQ ID NO: 10924 - RNA, 20 nt, Artificial Sequence
  spacer sequence
guuuggugguggcggcugcg

SEQ ID NO: 10925 - RNA, 20 nt, Artificial Sequence
  spacer sequence
gcgucucgcugacacggccc

SEQ ID NO: 10926 - RNA, 20 nt, Artificial Sequence
  spacer sequence
cgcugacacggccccccgcg

SEQ ID NO: 10927 - RNA, 20 nt, Artificial Sequence
  spacer sequence
cugacacggccccccgcgcc

SEQ ID NO: 10928 - RNA, 20 nt, Artificial Sequence
  spacer sequence
gcgagacgcagagcgcagcc

SEQ ID NO: 10929 - RNA, 20 nt, Artificial Sequence
  spacer sequence
cgcacuggcucacacuggcc

SEQ ID NO: 10930 - RNA, 20 nt, Artificial Sequence
  spacer sequence
cacuggcccggccggcgagc

SEQ ID NO: 10931 - RNA, 20 nt, Artificial Sequence
  spacer sequence
ccggccgggccagugugagc

SEQ ID NO: 10932 - RNA, 20 nt, Artificial Sequence
  spacer sequence
cucucccucucuccagcggg

SEQ ID NO: 10933 - RNA, 20 nt, Artificial Sequence
  spacer sequence
cucccucucuccagcgggau

SEQ ID NO: 10934 - RNA, 20 nt, Artificial Sequence
  spacer sequence
cccucucuccagcgggaugg

SEQ ID NO: 10935 - RNA, 20 nt, Artificial Sequence
  spacer sequence
cucucuccagcgggauggcg

SEQ ID NO: 10936 - RNA, 20 nt, Artificial Sequence
  spacer sequence
cuccagcgggauggcggcag

SEQ ID NO: 10937 - RNA, 20 nt, Artificial Sequence
  spacer sequence
ccagcgggauggcggcagcg

SEQ ID NO: 10938 - RNA, 20 nt, Artificial Sequence
  spacer sequence
agcgggauggcggcagcggc

SEQ ID NO: 10939 - RNA, 20 nt, Artificial Sequence
  spacer sequence
cgcuggagagagggagagag

SEQ ID NO: 10940 - RNA, 20 nt, Artificial Sequence
  spacer sequence
ggccgcugccgccaucccgc

SEQ ID NO: 10941 - RNA, 20 nt, Artificial Sequence
  spacer sequence
acgccgcgcggggcacccug

SEQ ID NO: 10942 - RNA, 20 nt, Artificial Sequence
  spacer sequence
cagggugccccgcgcggcgu

SEQ ID NO: 10943 - RNA, 20 nt, Artificial Sequence
  spacer sequence
ggccucccggcgcuuccugu

SEQ ID NO: 10944 - RNA, 20 nt, Artificial Sequence
  spacer sequence
cggcgcuuccugugcccggc

SEQ ID NO: 10945 - RNA, 20 nt, Artificial Sequence
  spacer sequence
ugugcccggcguucgccccg

SEQ ID NO: 10946 - RNA, 20 nt, Artificial Sequence
  spacer sequence
ccccgccccgucgcgcuggc

SEQ ID NO: 10947 - RNA, 20 nt, Artificial Sequence
  spacer sequence
cgcuggccccgcccccuccc

SEQ ID NO: 10948 - RNA, 20 nt, Artificial Sequence
  spacer sequence
ccgccucgucccgcccugcg

SEQ ID NO: 10949 - RNA, 20 nt, Artificial Sequence
  spacer sequence
ucccgcccugcgccgcccug

SEQ ID NO: 10950 - RNA, 20 nt, Artificial Sequence
  spacer sequence
cgcccugcgccgcccugcac

SEQ ID NO: 10951 - RNA, 20 nt, Artificial Sequence
  spacer sequence
cgcgccagcagcccugcacg

SEQ ID NO: 10952 - RNA, 20 nt, Artificial Sequence
  spacer sequence
cggcgucacgcgccagcagc

SEQ ID NO: 10953 - RNA, 20 nt, Artificial Sequence
  spacer sequence
cgccggcggcggcggcggcc

SEQ ID NO: 10954 - RNA, 20 nt, Artificial Sequence
  spacer sequence
ccggcccgcggccgcggccg

SEQ ID NO: 10955 - RNA, 20 nt, Artificial Sequence
  spacer sequence
ccccggcccgcggccgcggc

SEQ ID NO: 10956 - RNA, 20 nt, Artificial Sequence
  spacer sequence
gcaaggccgucuccccggcc

SEQ ID NO: 10957 - RNA, 20 nt, Artificial Sequence
  spacer sequence
cgcgcucugcaaggccgucu

SEQ ID NO: 10958 - RNA, 20 nt, Artificial Sequence
  spacer sequence
cagggcugcgagggugaccc

SEQ ID NO: 10959 - RNA, 20 nt, Artificial Sequence
  spacer sequence
cagcccugggaucccgcgcu

SEQ ID NO: 10960 - RNA, 20 nt, Artificial Sequence
  spacer sequence
cccucgcagcccugggaucc

SEQ ID NO: 10961 - RNA, 20 nt, Artificial Sequence
  spacer sequence
gggucacccucgcagcccug

SEQ ID NO: 10962 - RNA, 20 nt, Artificial Sequence
  spacer sequence
gcucgacgcggugcucccgg

SEQ ID NO: 10963 - RNA, 20 nt, Artificial Sequence
  spacer sequence
acgcggugcucccggggugc

SEQ ID NO: 10964 - RNA, 20 nt, Artificial Sequence
  spacer sequence
agcggagcgcgcgugcgcca

SEQ ID NO: 10965 - RNA, 20 nt, Artificial Sequence
  spacer sequence
cggggugcgucucugcgaaa

SEQ ID NO: 10966 - RNA, 20 nt, Artificial Sequence
  spacer sequence
cugcgaaacgcucggcccua

SEQ ID NO: 10967 - RNA, 20 nt, Artificial Sequence
  spacer sequence
gcgaaacgcucggcccuaac

SEQ ID NO: 10968 - RNA, 20 nt, Artificial Sequence
  spacer sequence
cagagacgcaccccgggagc

SEQ ID NO: 10969 - RNA, 20 nt, Artificial Sequence
  spacer sequence
gcccuaaccggcccugcacc

SEQ ID NO: 10970 - RNA, 20 nt, Artificial Sequence
  spacer sequence
gugcccgccgcccccgccgg

SEQ ID NO: 10971 - RNA, 20 nt, Artificial Sequence
  spacer sequence
cggcugccgcgaacaaaggg

SEQ ID NO: 10972 - RNA, 20 nt, Artificial Sequence
  spacer sequence
gcugccgcgaacaaagggcg

SEQ ID NO: 10973 - RNA, 20 nt, Artificial Sequence
  spacer sequence
cggcagccgagagccagcgg

SEQ ID NO: 10974 - RNA, 20 nt, Artificial Sequence
  spacer sequence
ugcgcccuuuguucgcggca

SEQ ID NO: 10975 - RNA, 20 nt, Artificial Sequence
  spacer sequence
gcucucugggcgugccuuug

SEQ ID NO: 10976 - RNA, 20 nt, Artificial Sequence
  spacer sequence
cugggcgugccuuugcaggc

SEQ ID NO: 10977 - RNA, 20 nt, Artificial Sequence
  spacer sequence
gggcgugccuuugcaggccc

SEQ ID NO: 10978 - RNA, 20 nt, Artificial Sequence
  spacer sequence
ugcgcucugcuggggaaaag

SEQ ID NO: 10979 - RNA, 20 nt, Artificial Sequence
  spacer sequence
gcuggggaaaagaaaaaaag

SEQ ID NO: 10980 - RNA, 20 nt, Artificial Sequence
  spacer sequence
ccagcagagcgcacgagggc

SEQ ID NO: 10981 - RNA, 20 nt, Artificial Sequence
  spacer sequence
uuuccccagcagagcgcacg

SEQ ID NO: 10982 - RNA, 20 nt, Artificial Sequence
  spacer sequence
gccaaugccagugcagcugu

SEQ ID NO: 10983 - RNA, 20 nt, Artificial Sequence
  spacer sequence
gcuguaguugugcagguuaa

SEQ ID NO: 10984 - RNA, 20 nt, Artificial Sequence
  spacer sequence
gcgcgagcgaaaacaccgag

SEQ ID NO: 10985 - RNA, 20 nt, Artificial Sequence
  spacer sequence
cgcagaauuaaccugcacaa

SEQ ID NO: 10986 - RNA, 20 nt, Artificial Sequence
  spacer sequence
cucgcgcagaauuaaccugc

SEQ ID NO: 10987 - RNA, 20 nt, Artificial Sequence
  spacer sequence
guguuuucgcucgcgcagaa

SEQ ID NO: 10988 - RNA, 20 nt, Artificial Sequence
  spacer sequence
cgguguuuucgcucgcgcag

SEQ ID NO: 10989 - RNA, 20 nt, Artificial Sequence
  spacer sequence
uucucgguguuuucgcucgc

SEQ ID NO: 10990 - RNA, 20 nt, Artificial Sequence
  spacer sequence
ggcacuggauauccacgcag

SEQ ID NO: 10991 - RNA, 20 nt, Artificial Sequence
  spacer sequence
agugccugaacgucuuucuc

SEQ ID NO: 10992 - RNA, 20 nt, Artificial Sequence
  spacer sequence
acgcaggccuuaaggaaccc

SEQ ID NO: 10993 - RNA, 20 nt, Artificial Sequence
  spacer sequence
uuaaggccugcguggauauc

SEQ ID NO: 10994 - RNA, 20 nt, Artificial Sequence
  spacer sequence
uggcacaaggcugcacaggg

SEQ ID NO: 10995 - RNA, 20 nt, Artificial Sequence
  spacer sequence
cguggcacaaggcugcacag

SEQ ID NO: 10996 - RNA, 20 nt, Artificial Sequence
  spacer sequence
ucucguggcacaaggcugca

SEQ ID NO: 10997 - RNA, 20 nt, Artificial Sequence
  spacer sequence
acuccucucguggcacaagg

SEQ ID NO: 10998 - RNA, 20 nt, Artificial Sequence
  spacer sequence
cuaacuuucacgcugauucc

SEQ ID NO: 10999 - RNA, 20 nt, Artificial Sequence
  spacer sequence
cgcugauuccucaaaccaag

SEQ ID NO: 11000 - RNA, 20 nt, Artificial Sequence
  spacer sequence
gcgugaaaguuagugaaucc

SEQ ID NO: 11001 - RNA, 20 nt, Artificial Sequence
  spacer sequence
ucaaaccaaguuguuucauu

SEQ ID NO: 11002 - RNA, 20 nt, Artificial Sequence
  spacer sequence
aaccaaguuguuucauuuuu

SEQ ID NO: 11003 - RNA, 20 nt, Artificial Sequence
  spacer sequence
uuuuuggccaaaacucuuua

SEQ ID NO: 11004 - RNA, 20 nt, Artificial Sequence
  spacer sequence
uuauguugaucacuuuccuu

SEQ ID NO: 11005 - RNA, 20 nt, Artificial Sequence
  spacer sequence
acauaaagaguuuuggccaa

SEQ ID NO: 11006 - RNA, 20 nt, Artificial Sequence
  spacer sequence
cuuuccuugaguaccuacug

SEQ ID NO: 11007 - RNA, 20 nt, Artificial Sequence
  spacer sequence
uugaguaccuacugucugcc

SEQ ID NO: 11008 - RNA, 20 nt, Artificial Sequence
  spacer sequence
aggaaagugaucaacauaaa

SEQ ID NO: 11009 - RNA, 20 nt, Artificial Sequence
  spacer sequence
gccuaguguuggagacaugg

SEQ ID NO: 11010 - RNA, 20 nt, Artificial Sequence
  spacer sequence
aacacuaggcagacaguagg

SEQ ID NO: 11011 - RNA, 20 nt, Artificial Sequence
  spacer sequence
ccaacacuaggcagacagua

SEQ ID NO: 11012 - RNA, 20 nt, Artificial Sequence
  spacer sequence
augucuccaacacuaggcag

SEQ ID NO: 11013 - RNA, 20 nt, Artificial Sequence
  spacer sequence
uuuauuuccaugucuccaac

SEQ ID NO: 11014 - RNA, 20 nt, Artificial Sequence
  spacer sequence
ggcaaaacaauuaucguuua

SEQ ID NO: 11015 - RNA, 20 nt, Artificial Sequence
  spacer sequence
acuaaacugugcuguuuuca

SEQ ID NO: 11016 - RNA, 20 nt, Artificial Sequence
  spacer sequence
ccacuaaacugugcuguuuu

SEQ ID NO: 11017 - RNA, 20 nt, Artificial Sequence
  spacer sequence
ucuccacuaaacugugcugu

SEQ ID NO: 11018 - RNA, 20 nt, Artificial Sequence
  spacer sequence
guccucuccacuaaacugug

SEQ ID NO: 11019 - RNA, 20 nt, Artificial Sequence
  spacer sequence
guugucuguccucuccacua

SEQ ID NO: 11020 - RNA, 20 nt, Artificial Sequence
  spacer sequence
gcucaguugucuguccucuc

SEQ ID NO: 11021 - RNA, 20 nt, Artificial Sequence
  spacer sequence
cagggccugugcccuaacac

SEQ ID NO: 11022 - RNA, 20 nt, Artificial Sequence
  spacer sequence
uuucccagggccugugcccu

SEQ ID NO: 11023 - RNA, 20 nt, Artificial Sequence
  spacer sequence
cguuucccagggccugugcc

SEQ ID NO: 11024 - RNA, 20 nt, Artificial Sequence
  spacer sequence
uucucguuucccagggccug

SEQ ID NO: 11025 - RNA, 20 nt, Artificial Sequence
  spacer sequence
gacaggaaguccaggcuaca

SEQ ID NO: 11026 - RNA, 20 nt, Artificial Sequence
  spacer sequence
gaggcgcaucuuucucguuu

SEQ ID NO: 11027 - RNA, 20 nt, Artificial Sequence
  spacer sequence
ugucggaggcgcaucuuucu

SEQ ID NO: 11028 - RNA, 20 nt, Artificial Sequence
  spacer sequence
aggcuacaucuggagggagg

SEQ ID NO: 11029 - RNA, 20 nt, Artificial Sequence
  spacer sequence
ggagggaggagaggccugca

SEQ ID NO: 11030 - RNA, 20 nt, Artificial Sequence
  spacer sequence
agauguagccuggacuuccu

SEQ ID NO: 11031 - RNA, 20 nt, Artificial Sequence
  spacer sequence
cuccagauguagccuggacu

SEQ ID NO: 11032 - RNA, 20 nt, Artificial Sequence
  spacer sequence
ucccuccagauguagccugg

SEQ ID NO: 11033 - RNA, 20 nt, Artificial Sequence
  spacer sequence
ccucccuccagauguagccu

SEQ ID NO: 11034 - RNA, 20 nt, Artificial Sequence
  spacer sequence
gcaggccucuccucccucca

SEQ ID NO: 11035 - RNA, 20 nt, Artificial Sequence
  spacer sequence
ggcucugcaggccucuccuc

SEQ ID NO: 11036 - RNA, 20 nt, Artificial Sequence
  spacer sequence
ucaggcucugcaggccucuc

SEQ ID NO: 11037 - RNA, 20 nt, Artificial Sequence
  spacer sequence
ucaucaggcucugcaggccu

SEQ ID NO: 11038 - RNA, 20 nt, Artificial Sequence
  spacer sequence
ccucccccgaaggaggacca

SEQ ID NO: 11039 - RNA, 20 nt, Artificial Sequence
  spacer sequence
cccgaaggaggaccagcugg

SEQ ID NO: 11040 - RNA, 20 nt, Artificial Sequence
  spacer sequence
ggggaggugaugguggcagu

SEQ ID NO: 11041 - RNA, 20 nt, Artificial Sequence
  spacer sequence
uucgggggaggugauggugg

SEQ ID NO: 11042 - RNA, 20 nt, Artificial Sequence
  spacer sequence
uccuucgggggaggugaugg

SEQ ID NO: 11043 - RNA, 20 nt, Artificial Sequence
  spacer sequence
agcugguccuccuucggggg

SEQ ID NO: 11044 - RNA, 20 nt, Artificial Sequence
  spacer sequence
gcuccagcugguccuccuuc

SEQ ID NO: 11045 - RNA, 20 nt, Artificial Sequence
  spacer sequence
ucagcuccagcugguccucc

SEQ ID NO: 11046 - RNA, 20 nt, Artificial Sequence
  spacer sequence
accuugcuccucagcuccag

SEQ ID NO: 11047 - RNA, 20 nt, Artificial Sequence
  spacer sequence
guccaccuugcuccucagcu

SEQ ID NO: 11048 - RNA, 20 nt, Artificial Sequence
  spacer sequence
caguccaccuugcuccucag

SEQ ID NO: 11049 - RNA, 20 nt, Artificial Sequence
  spacer sequence
cucaguccaccuugcuccuc

SEQ ID NO: 11050 - RNA, 20 nt, Artificial Sequence
  spacer sequence
ucucucaguccaccuugcuc

SEQ ID NO: 11051 - RNA, 20 nt, Artificial Sequence
  spacer sequence
ccucucucaguccaccuugc

SEQ ID NO: 11052 - RNA, 20 nt, Artificial Sequence
  spacer sequence
cucuccucucucaguccacc

SEQ ID NO: 11053 - RNA, 20 nt, Artificial Sequence
  spacer sequence
cacucuccucucucagucca

SEQ ID NO: 11054 - RNA, 20 nt, Artificial Sequence
  spacer sequence
uuauggucucacucuccucu

SEQ ID NO: 11055 - RNA, 20 nt, Artificial Sequence
  spacer sequence
uccagaguuuggauuuugcc

SEQ ID NO: 11056 - RNA, 20 nt, Artificial Sequence
  spacer sequence
agaguuuggauuuugccccc

SEQ ID NO: 11057 - RNA, 20 nt, Artificial Sequence
  spacer sequence
ggaagagcaaagccucuuua

SEQ ID NO: 11058 - RNA, 20 nt, Artificial Sequence
  spacer sequence
aaacucuggaagagcaaagc

SEQ ID NO: 11059 - RNA, 20 nt, Artificial Sequence
  spacer sequence
gccuuaugggggcaaaaucc

SEQ ID NO: 11060 - RNA, 20 nt, Artificial Sequence
  spacer sequence
ccucugccuuaugggggcaa

SEQ ID NO: 11061 - RNA, 20 nt, Artificial Sequence
  spacer sequence
agggcuccccucugccuuau

SEQ ID NO: 11062 - RNA, 20 nt, Artificial Sequence
  spacer sequence
ccuuucaagggcuccccucu

SEQ ID NO: 11063 - RNA, 20 nt, Artificial Sequence
  spacer sequence
accuuccccuuucaagggcu

SEQ ID NO: 11064 - RNA, 20 nt, Artificial Sequence
  spacer sequence
cuccaccuuccccuuucaag

SEQ ID NO: 11065 - RNA, 20 nt, Artificial Sequence
  spacer sequence
aucacuccaccuuccccuuu

SEQ ID NO: 11066 - RNA, 20 nt, Artificial Sequence
  spacer sequence
cucagaaggauggugcaaag

SEQ ID NO: 11067 - RNA, 20 nt, Artificial Sequence
  spacer sequence
cagaaggauggugcaaagua

SEQ ID NO: 11068 - RNA, 20 nt, Artificial Sequence
  spacer sequence
gaaggauggugcaaaguagu

SEQ ID NO: 11069 - RNA, 20 nt, Artificial Sequence
  spacer sequence
gagagaacacugcauccauc

SEQ ID NO: 11070 - RNA, 20 nt, Artificial Sequence
  spacer sequence
uucugagagaacacugcauc

SEQ ID NO: 11071 - RNA, 20 nt, Artificial Sequence
  spacer sequence
uacuacuuugcaccauccuu

SEQ ID NO: 11072 - RNA, 20 nt, Artificial Sequence
  spacer sequence
ucuuacuacuuugcaccauc

SEQ ID NO: 11073 - RNA, 20 nt, Artificial Sequence
  spacer sequence
ccucuuacuacuuugcacca

SEQ ID NO: 11074 - RNA, 20 nt, Artificial Sequence
  spacer sequence
cugucuccucuuacuacuuu

SEQ ID NO: 11075 - RNA, 20 nt, Artificial Sequence
  spacer sequence
uucccugucuccucuuacua

SEQ ID NO: 11076 - RNA, 20 nt, Artificial Sequence
  spacer sequence
uucuuucccugucuccucuu

SEQ ID NO: 11077 - RNA, 20 nt, Artificial Sequence
  spacer sequence
cagggggcuggggucauucu

SEQ ID NO: 11078 - RNA, 20 nt, Artificial Sequence
  spacer sequence
uuuucccagggggcuggggu

SEQ ID NO: 11079 - RNA, 20 nt, Artificial Sequence
  spacer sequence
gcccucauuuucccaggggg

SEQ ID NO: 11080 - RNA, 20 nt, Artificial Sequence
  spacer sequence
ccaccaccuucagcccucau

SEQ ID NO: 11081 - RNA, 20 nt, Artificial Sequence
  spacer sequence
aucgccaccaccuucagccc

SEQ ID NO: 11082 - RNA, 20 nt, Artificial Sequence
  spacer sequence
cuaucgccaccaccuucagc

SEQ ID NO: 11083 - RNA, 20 nt, Artificial Sequence
  spacer sequence
uucucuaucgccaccaccuu

SEQ ID NO: 11084 - RNA, 20 nt, Artificial Sequence
  spacer sequence
uccuucucuaucgccaccac

SEQ ID NO: 11085 - RNA, 20 nt, Artificial Sequence
  spacer sequence
guucuuccuucucuaucgcc

SEQ ID NO: 11086 - RNA, 20 nt, Artificial Sequence
  spacer sequence
uaaacaucuguucuuccuuc

SEQ ID NO: 11087 - RNA, 20 nt, Artificial Sequence
  spacer sequence
acuuccuaaacaucuguucu

SEQ ID NO: 11088 - RNA, 20 nt, Artificial Sequence
  spacer sequence
acuccacuuccuaaacaucu

SEQ ID NO: 11089 - RNA, 20 nt, Artificial Sequence
  spacer sequence
gcccuuccacuccacuuccu

SEQ ID NO: 11090 - RNA, 20 nt, Artificial Sequence
  spacer sequence
gccucagcccuuccacucca

SEQ ID NO: 11091 - RNA, 20 nt, Artificial Sequence
  spacer sequence
caguuacucugccucagccc

SEQ ID NO: 11092 - RNA, 20 nt, Artificial Sequence
  spacer sequence
aggaggaugcccacagccug

SEQ ID NO: 11093 - RNA, 20 nt, Artificial Sequence
  spacer sequence
uugacacccccuuuauuaac

SEQ ID NO: 11094 - RNA, 20 nt, Artificial Sequence
  spacer sequence
uccuugacacccccuuuauu

SEQ ID NO: 11095 - RNA, 20 nt, Artificial Sequence
  spacer sequence
ggcugugggcauccuccuug

SEQ ID NO: 11096 - RNA, 20 nt, Artificial Sequence
  spacer sequence
agucaggcugugggcauccu

SEQ ID NO: 11097 - RNA, 20 nt, Artificial Sequence
  spacer sequence
ucaagucaggcugugggcau

SEQ ID NO: 11098 - RNA, 20 nt, Artificial Sequence
  spacer sequence
uucaucaagucaggcugugg

SEQ ID NO: 11099 - RNA, 20 nt, Artificial Sequence
  spacer sequence
uaaacccaccacccagguca

SEQ ID NO: 11100 - RNA, 20 nt, Artificial Sequence
  spacer sequence
acguaggggauuuaugggga

SEQ ID NO: 11101 - RNA, 20 nt, Artificial Sequence
  spacer sequence
ccuacguugacucauaaacc

SEQ ID NO: 11102 - RNA, 20 nt, Artificial Sequence
  spacer sequence
ccauaaauccccuacguuga

SEQ ID NO: 11103 - RNA, 20 nt, Artificial Sequence
  spacer sequence
uccccauaaauccccuacgu

SEQ ID NO: 11104 - RNA, 20 nt, Artificial Sequence
  spacer sequence
aacccacgccuucuucccca

SEQ ID NO: 11105 - RNA, 20 nt, Artificial Sequence
  spacer sequence
cucaaacccacgccuucuuc

SEQ ID NO: 11106 - RNA, 20 nt, Artificial Sequence
  spacer sequence
ucccucaaacccacgccuuc

SEQ ID NO: 11107 - RNA, 20 nt, Artificial Sequence
  spacer sequence
gucuucccucaaacccacgc

SEQ ID NO: 11108 - RNA, 20 nt, Artificial Sequence
  spacer sequence
uucugucuucccucaaaccc

SEQ ID NO: 11109 - RNA, 20 nt, Artificial Sequence
  spacer sequence
cuuaccaugugccaacgucu

SEQ ID NO: 11110 - RNA, 20 nt, Artificial Sequence
  spacer sequence
gcugacaugcuauucuguac

SEQ ID NO: 11111 - RNA, 20 nt, Artificial Sequence
  spacer sequence
gcagacguuggcacauggua

SEQ ID NO: 11112 - RNA, 20 nt, Artificial Sequence
  spacer sequence
guacucuccguaacaggcuu

SEQ ID NO: 11113 - RNA, 20 nt, Artificial Sequence
  spacer sequence
ccguaacaggcuucugggug

SEQ ID NO: 11114 - RNA, 20 nt, Artificial Sequence
  spacer sequence
guaacaggcuucugggugag

SEQ ID NO: 11115 - RNA, 20 nt, Artificial Sequence
  spacer sequence
gggugagguguccauuagua

SEQ ID NO: 11116 - RNA, 20 nt, Artificial Sequence
  spacer sequence
cccagaagccuguuacggag

SEQ ID NO: 11117 - RNA, 20 nt, Artificial Sequence
  spacer sequence
auuaguaaugcccucauuuu

SEQ ID NO: 11118 - RNA, 20 nt, Artificial Sequence
  spacer sequence
uuuuauaauucagggaguga

SEQ ID NO: 11119 - RNA, 20 nt, Artificial Sequence
  spacer sequence
gggagugaguuaauuaaugu

SEQ ID NO: 11120 - RNA, 20 nt, Artificial Sequence
  spacer sequence
cugaauuauaaaaugagggc

SEQ ID NO: 11121 - RNA, 20 nt, Artificial Sequence
  spacer sequence
cucccugaauuauaaaauga

SEQ ID NO: 11122 - RNA, 20 nt, Artificial Sequence
  spacer sequence
cacagcuggaucauuucccu

SEQ ID NO: 11123 - RNA, 20 nt, Artificial Sequence
  spacer sequence
agcugugugaccuugggcac

SEQ ID NO: 11124 - RNA, 20 nt, Artificial Sequence
  spacer sequence
uuucccuuuggugccugugg

SEQ ID NO: 11125 - RNA, 20 nt, Artificial Sequence
  spacer sequence
cuuuggugccuguggaguuu

SEQ ID NO: 11126 - RNA, 20 nt, Artificial Sequence
  spacer sequence
acaggcaccaaagggaaaug

SEQ ID NO: 11127 - RNA, 20 nt, Artificial Sequence
  spacer sequence
aacuccacaggcaccaaagg

SEQ ID NO: 11128 - RNA, 20 nt, Artificial Sequence
  spacer sequence
caggcgcagcucaaacucca

SEQ ID NO: 11129 - RNA, 20 nt, Artificial Sequence
  spacer sequence
cuuacuugucccaggcgcag

SEQ ID NO: 11130 - RNA, 20 nt, Artificial Sequence
  spacer sequence
ucacuuacuugucccaggcg

SEQ ID NO: 11131 - RNA, 20 nt, Artificial Sequence
  spacer sequence
aggaggcaguuggguaaaca

SEQ ID NO: 11132 - RNA, 20 nt, Artificial Sequence
  spacer sequence
uagacauccucacuuacuug

SEQ ID NO: 11133 - RNA, 20 nt, Artificial Sequence
  spacer sequence
gcaaguguuuacccaacugc

SEQ ID NO: 11134 - RNA, 20 nt, Artificial Sequence
  spacer sequence
ggagcgauggcugagaugau

SEQ ID NO: 11135 - RNA, 20 nt, Artificial Sequence
  spacer sequence
ugacucugcaaguguuuacc

SEQ ID NO: 11136 - RNA, 20 nt, Artificial Sequence
  spacer sequence
cuccugacucugcaaguguu

SEQ ID NO: 11137 - RNA, 20 nt, Artificial Sequence
  spacer sequence
gccaucgcuccugacucugc

SEQ ID NO: 11138 - RNA, 20 nt, Artificial Sequence
  spacer sequence
cagccaucgcuccugacucu

SEQ ID NO: 11139 - RNA, 20 nt, Artificial Sequence
  spacer sequence
ucucagccaucgcuccugac

SEQ ID NO: 11140 - RNA, 20 nt, Artificial Sequence
  spacer sequence
aucaucucagccaucgcucc

SEQ ID NO: 11141 - RNA, 20 nt, Artificial Sequence
  spacer sequence
gggagucauuagugcacagc

SEQ ID NO: 11142 - RNA, 20 nt, Artificial Sequence
  spacer sequence
cagauuucuaucaucucagc

SEQ ID NO: 11143 - RNA, 20 nt, Artificial Sequence
  spacer sequence
uuagugcacagcuaguggug

SEQ ID NO: 11144 - RNA, 20 nt, Artificial Sequence
  spacer sequence
accacuagcugugcacuaau

SEQ ID NO: 11145 - RNA, 20 nt, Artificial Sequence
  spacer sequence
uuccaccacuagcugugcac

SEQ ID NO: 11146 - RNA, 20 nt, Artificial Sequence
  spacer sequence
gcuccuuccaccacuagcug

SEQ ID NO: 11147 - RNA, 20 nt, Artificial Sequence
  spacer sequence
auuucagcuccuuccaccac

SEQ ID NO: 11148 - RNA, 20 nt, Artificial Sequence
  spacer sequence
cccuaucuauuucagcuccu

SEQ ID NO: 11149 - RNA, 20 nt, Artificial Sequence
  spacer sequence
ugggcuuuuucccccuaucu

SEQ ID NO: 11150 - RNA, 20 nt, Artificial Sequence
  spacer sequence
cuuacauacccguguuccug

SEQ ID NO: 11151 - RNA, 20 nt, Artificial Sequence
  spacer sequence
aacuuaucccuuacauaccc

SEQ ID NO: 11152 - RNA, 20 nt, Artificial Sequence
  spacer sequence
ugccuccaacuuaucccuua

SEQ ID NO: 11153 - RNA, 20 nt, Artificial Sequence
  spacer sequence
ucuugccuccaacuuauccc

SEQ ID NO: 11154 - RNA, 20 nt, Artificial Sequence
  spacer sequence
ccucuucuugccuccaacuu

SEQ ID NO: 11155 - RNA, 20 nt, Artificial Sequence
  spacer sequence
ucaccucuucuugccuccaa

SEQ ID NO: 11156 - RNA, 20 nt, Artificial Sequence
  spacer sequence
cuucaccucuucuugccucc

SEQ ID NO: 11157 - RNA, 20 nt, Artificial Sequence
  spacer sequence
cucuucaccucuucuugccu

SEQ ID NO: 11158 - RNA, 20 nt, Artificial Sequence
  spacer sequence
gaagugaucagcucugucug

SEQ ID NO: 11159 - RNA, 20 nt, Artificial Sequence
  spacer sequence
gagcucucucuucaccucuu

SEQ ID NO: 11160 - RNA, 20 nt, Artificial Sequence
  spacer sequence
cuucagagcucucucuucac

SEQ ID NO: 11161 - RNA, 20 nt, Artificial Sequence
  spacer sequence
gcucugucuggugcuuggag

SEQ ID NO: 11162 - RNA, 20 nt, Artificial Sequence
  spacer sequence
gucuggugcuuggaguagaa

SEQ ID NO: 11163 - RNA, 20 nt, Artificial Sequence
  spacer sequence
ggugcuuggaguagaagucc

SEQ ID NO: 11164 - RNA, 20 nt, Artificial Sequence
  spacer sequence
aagcaccagacagagcugau

SEQ ID NO: 11165 - RNA, 20 nt, Artificial Sequence
  spacer sequence
acuccaagcaccagacagag

SEQ ID NO: 11166 - RNA, 20 nt, Artificial Sequence
  spacer sequence
agcaagauaagaauuggaaa

SEQ ID NO: 11167 - RNA, 20 nt, Artificial Sequence
  spacer sequence
ugcuggacuucuacuccaag

SEQ ID NO: 11168 - RNA, 20 nt, Artificial Sequence
  spacer sequence
uaucuugcuggacuucuacu

SEQ ID NO: 11169 - RNA, 20 nt, Artificial Sequence
  spacer sequence
aauucuuaucuugcuggacu

SEQ ID NO: 11170 - RNA, 20 nt, Artificial Sequence
  spacer sequence
ggcacuuuccaauucuuauc

SEQ ID NO: 11171 - RNA, 20 nt, Artificial Sequence
  spacer sequence
cugcauguagcacccgucag

SEQ ID NO: 11172 - RNA, 20 nt, Artificial Sequence
  spacer sequence
ugcguguaggcuggcguggu

SEQ ID NO: 11173 - RNA, 20 nt, Artificial Sequence
  spacer sequence
ccacgccagccuacacgcag

SEQ ID NO: 11174 - RNA, 20 nt, Artificial Sequence
  spacer sequence
agcuuuugcccucaccacgc

SEQ ID NO: 11175 - RNA, 20 nt, Artificial Sequence
  spacer sequence
gucuagcuuuugcccucacc

SEQ ID NO: 11176 - RNA, 20 nt, Artificial Sequence
  spacer sequence
aagaggggaaggcaggcagg

SEQ ID NO: 11177 - RNA, 20 nt, Artificial Sequence
  spacer sequence
uugauacacaucagucuagc

SEQ ID NO: 11178 - RNA, 20 nt, Artificial Sequence
  spacer sequence
ccucuuugauacacaucagu

SEQ ID NO: 11179 - RNA, 20 nt, Artificial Sequence
  spacer sequence
ugccugccuuccccucuuug

SEQ ID NO: 11180 - RNA, 20 nt, Artificial Sequence
  spacer sequence
ccugccugccuuccccucuu

SEQ ID NO: 11181 - RNA, 20 nt, Artificial Sequence
  spacer sequence
auaaacuuucuccugccugc

SEQ ID NO: 11182 - RNA, 20 nt, Artificial Sequence
  spacer sequence
cagccaaguuucuauaaacu

SEQ ID NO: 11183 - RNA, 20 nt, Artificial Sequence
  spacer sequence
caacuugccuucacagccaa

SEQ ID NO: 11184 - RNA, 20 nt, Artificial Sequence
  spacer sequence
ucacaacuugccuucacagc

SEQ ID NO: 11185 - RNA, 20 nt, Artificial Sequence
  spacer sequence
guugucuucacaacuugccu

SEQ ID NO: 11186 - RNA, 20 nt, Artificial Sequence
  spacer sequence
ugcagguuuuuucuguuguc

SEQ ID NO: 11187 - RNA, 20 nt, Artificial Sequence
  spacer sequence
uccugcagguuuuuucuguu

SEQ ID NO: 11188 - RNA, 20 nt, Artificial Sequence
  spacer sequence
cuuccuccugcagguuuuuu

SEQ ID NO: 11189 - RNA, 20 nt, Artificial Sequence
  spacer sequence
cacuuccuccugcagguuuu

SEQ ID NO: 11190 - RNA, 20 nt, Artificial Sequence
  spacer sequence
aaacaaaacaacacacaagc

SEQ ID NO: 11191 - RNA, 20 nt, Artificial Sequence
  spacer sequence
caaaacaaaacaacacacaa

SEQ ID NO: 11192 - RNA, 20 nt, Artificial Sequence
  spacer sequence
ucucaaaacaaaacaacaca

SEQ ID NO: 11193 - RNA, 20 nt, Artificial Sequence
  spacer sequence
caucucaaaacaaaacaaca

SEQ ID NO: 11194 - RNA, 20 nt, Artificial Sequence
  spacer sequence
uuuuuaaaauuauuuuauuu

SEQ ID NO: 11195 - RNA, 20 nt, Artificial Sequence
  spacer sequence
uccgcaagaccacuaacauu

SEQ ID NO: 11196 - RNA, 20 nt, Artificial Sequence
  spacer sequence
gcaagaccacuaacauugca

SEQ ID NO: 11197 - RNA, 20 nt, Artificial Sequence
  spacer sequence
ugcggaugacagcuguuaca

SEQ ID NO: 11198 - RNA, 20 nt, Artificial Sequence
  spacer sequence
aaugcaauguuaguggucuu

SEQ ID NO: 11199 - RNA, 20 nt, Artificial Sequence
  spacer sequence
guacuuucuaaugcaauguu

SEQ ID NO: 11200 - RNA, 20 nt, Artificial Sequence
  spacer sequence
ugucuguacuuucuaaugca

SEQ ID NO: 11201 - RNA, 20 nt, Artificial Sequence
  spacer sequence
cgcgguggcucaugccugua

SEQ ID NO: 11202 - RNA, 20 nt, Artificial Sequence
  spacer sequence
ugccuguaaucccagaauuu

SEQ ID NO: 11203 - RNA, 20 nt, Artificial Sequence
  spacer sequence
caucuguacuuuuuuuuuuu

SEQ ID NO: 11204 - RNA, 20 nt, Artificial Sequence
  spacer sequence
acucacaucuguacuuuuuu

SEQ ID NO: 11205 - RNA, 20 nt, Artificial Sequence
  spacer sequence
cuguuuccuacccuuuggca

SEQ ID NO: 11206 - RNA, 20 nt, Artificial Sequence
  spacer sequence
guuuccuacccuuuggcauu

SEQ ID NO: 11207 - RNA, 20 nt, Artificial Sequence
  spacer sequence
uacccuuuggcauuuggcau

SEQ ID NO: 11208 - RNA, 20 nt, Artificial Sequence
  spacer sequence
ggagaucuacugucuaccaa

SEQ ID NO: 11209 - RNA, 20 nt, Artificial Sequence
  spacer sequence
agaaaugccaaaugccaaau

SEQ ID NO: 11210 - RNA, 20 nt, Artificial Sequence
  spacer sequence
ccagaaaugccaaaugccaa

SEQ ID NO: 11211 - RNA, 20 nt, Artificial Sequence
  spacer sequence
acugucuaccaaauucuguc

SEQ ID NO: 11212 - RNA, 20 nt, Artificial Sequence
  spacer sequence
accaaauucuguccaagauc

SEQ ID NO: 11213 - RNA, 20 nt, Artificial Sequence
  spacer sequence
guccaagauccccacaccau

SEQ ID NO: 11214 - RNA, 20 nt, Artificial Sequence
  spacer sequence
aagauccccacaccauguuu

SEQ ID NO: 11215 - RNA, 20 nt, Artificial Sequence
  spacer sequence
uggacagaauuugguagaca

SEQ ID NO: 11216 - RNA, 20 nt, Artificial Sequence
  spacer sequence
aaaggggguauuuucugugu

SEQ ID NO: 11217 - RNA, 20 nt, Artificial Sequence
  spacer sequence
guguaccauccuacugagau

SEQ ID NO: 11218 - RNA, 20 nt, Artificial Sequence
  spacer sequence
uacugagauuugaaugcaca

SEQ ID NO: 11219 - RNA, 20 nt, Artificial Sequence
  spacer sequence
guaggaugguacacagaaaa

SEQ ID NO: 11220 - RNA, 20 nt, Artificial Sequence
  spacer sequence
caguaggaugguacacagaa

SEQ ID NO: 11221 - RNA, 20 nt, Artificial Sequence
  spacer sequence
aaucucaguaggaugguaca

SEQ ID NO: 11222 - RNA, 20 nt, Artificial Sequence
  spacer sequence
ugugcauucaaaucucagua

SEQ ID NO: 11223 - RNA, 20 nt, Artificial Sequence
  spacer sequence
uguuucuugugcauucaaau

SEQ ID NO: 11224 - RNA, 20 nt, Artificial Sequence
  spacer sequence
aagauccaugugcuugagau

SEQ ID NO: 11225 - RNA, 20 nt, Artificial Sequence
  spacer sequence
uagaagccaaaucuuguuuc

SEQ ID NO: 11226 - RNA, 20 nt, Artificial Sequence
  spacer sequence
augugcuugagauaguuaac

SEQ ID NO: 11227 - RNA, 20 nt, Artificial Sequence
  spacer sequence
gccuggagagauaaagaugg

SEQ ID NO: 11228 - RNA, 20 nt, Artificial Sequence
  spacer sequence
ucugccuggagagauaaaga

SEQ ID NO: 11229 - RNA, 20 nt, Artificial Sequence
  spacer sequence
aaccuuccaauaggaaauuu

SEQ ID NO: 11230 - RNA, 20 nt, Artificial Sequence
  spacer sequence
acucgucugccuggagagau

SEQ ID NO: 11231 - RNA, 20 nt, Artificial Sequence
  spacer sequence
aauaggaaauuuuggguaaa

SEQ ID NO: 11232 - RNA, 20 nt, Artificial Sequence
  spacer sequence
uauuggaagguucgacucgu

SEQ ID NO: 11233 - RNA, 20 nt, Artificial Sequence
  spacer sequence
uuuacccaaaauuuccuauu

SEQ ID NO: 11234 - RNA, 20 nt, Artificial Sequence
  spacer sequence
uaaguuuuugucauuuaccc

SEQ ID NO: 11235 - RNA, 20 nt, Artificial Sequence
  spacer sequence
uuugugagcagacuuugaag

SEQ ID NO: 11236 - RNA, 20 nt, Artificial Sequence
  spacer sequence
caaaggacaacccucauaag

SEQ ID NO: 11237 - RNA, 20 nt, Artificial Sequence
  spacer sequence
gcucacaaaggacaacccuc

SEQ ID NO: 11238 - RNA, 20 nt, Artificial Sequence
  spacer sequence
ggccaucuuuucaauaggcu

SEQ ID NO: 11239 - RNA, 20 nt, Artificial Sequence
  spacer sequence
gaaauaagcgugacggauaa

SEQ ID NO: 11240 - RNA, 20 nt, Artificial Sequence
  spacer sequence
gaaccucuggccaucuuuuc

SEQ ID NO: 11241 - RNA, 20 nt, Artificial Sequence
  spacer sequence
cgcuuauuucugaaccucug

SEQ ID NO: 11242 - RNA, 20 nt, Artificial Sequence
  spacer sequence
gucacgcuuauuucugaacc

SEQ ID NO: 11243 - RNA, 20 nt, Artificial Sequence
  spacer sequence
gcaagacauuuaauacaucu

SEQ ID NO: 11244 - RNA, 20 nt, Artificial Sequence
  spacer sequence
ugcugauuuuuauccgucac

SEQ ID NO: 11245 - RNA, 20 nt, Artificial Sequence
  spacer sequence
gcaaacuugccuucuuucaa

SEQ ID NO: 11246 - RNA, 20 nt, Artificial Sequence
  spacer sequence
uucaaagaacauugauugaa

SEQ ID NO: 11247 - RNA, 20 nt, Artificial Sequence
  spacer sequence
aagaacauugauugaaacag

SEQ ID NO: 11248 - RNA, 20 nt, Artificial Sequence
  spacer sequence
aucaauguucuuugaaagaa

SEQ ID NO: 11249 - RNA, 20 nt, Artificial Sequence
  spacer sequence
guuucaaucaauguucuuug

SEQ ID NO: 11250 - RNA, 20 nt, Artificial Sequence
  spacer sequence
uuuguucauaaugugggugu

SEQ ID NO: 11251 - RNA, 20 nt, Artificial Sequence
  spacer sequence
uaaugugggugugaaaauag

SEQ ID NO: 11252 - RNA, 20 nt, Artificial Sequence
  spacer sequence
cacccacauuaugaacaaac

SEQ ID NO: 11253 - RNA, 20 nt, Artificial Sequence
  spacer sequence
gaaaagccauucuaaacaaa

SEQ ID NO: 11254 - RNA, 20 nt, Artificial Sequence
  spacer sequence
gaacuauuuucacacccaca

SEQ ID NO: 11255 - RNA, 20 nt, Artificial Sequence
  spacer sequence
aaacaaacuuauguuuuuaa

SEQ ID NO: 11256 - RNA, 20 nt, Artificial Sequence
  spacer sequence
uuuccuuccuccgcaaacag

SEQ ID NO: 11257 - RNA, 20 nt, Artificial Sequence
  spacer sequence
ucuuuuccuuccuccgcaaa

SEQ ID NO: 11258 - RNA, 20 nt, Artificial Sequence
  spacer sequence
ggaagcaauguucugguuaa

SEQ ID NO: 11259 - RNA, 20 nt, Artificial Sequence
  spacer sequence
ugaaugucaucuuuuccuuc

SEQ ID NO: 11260 - RNA, 20 nt, Artificial Sequence
  spacer sequence
gguuaauucuguguucuuca

SEQ ID NO: 11261 - RNA, 20 nt, Artificial Sequence
  spacer sequence
guguucuucaaaagccagcu

SEQ ID NO: 11262 - RNA, 20 nt, Artificial Sequence
  spacer sequence
ucaaaagccagcucauuuuc

SEQ ID NO: 11263 - RNA, 20 nt, Artificial Sequence
  spacer sequence
aaagccagcucauuuucuug

SEQ ID NO: 11264 - RNA, 20 nt, Artificial Sequence
  spacer sequence
uuuucuugaaaagaaugcug

SEQ ID NO: 11265 - RNA, 20 nt, Artificial Sequence
  spacer sequence
ugaaaagaaugcuggccaca

SEQ ID NO: 11266 - RNA, 20 nt, Artificial Sequence
  spacer sequence
agaaaaugagcuggcuuuug

SEQ ID NO: 11267 - RNA, 20 nt, Artificial Sequence
  spacer sequence
uuucaagaaaaugagcuggc

SEQ ID NO: 11268 - RNA, 20 nt, Artificial Sequence
  spacer sequence
acagguauagagaauaugga

SEQ ID NO: 11269 - RNA, 20 nt, Artificial Sequence
  spacer sequence
auaccuguggauuguggcca

SEQ ID NO: 11270 - RNA, 20 nt, Artificial Sequence
  spacer sequence
cuauaccuguggauuguggc

SEQ ID NO: 11271 - RNA, 20 nt, Artificial Sequence
  spacer sequence
auauucucuauaccugugga

SEQ ID NO: 11272 - RNA, 20 nt, Artificial Sequence
  spacer sequence
ccauauucucuauaccugug

SEQ ID NO: 11273 - RNA, 20 nt, Artificial Sequence
  spacer sequence
cuccauauucucuauaccug

SEQ ID NO: 11274 - RNA, 20 nt, Artificial Sequence
  spacer sequence
cacgccugaagaguccaaua

SEQ ID NO: 11275 - RNA, 20 nt, Artificial Sequence
  spacer sequence
cgccugaagaguccaauaaa

SEQ ID NO: 11276 - RNA, 20 nt, Artificial Sequence
  spacer sequence
ggcgugagaugcuuucucuc

SEQ ID NO: 11277 - RNA, 20 nt, Artificial Sequence
  spacer sequence
ucaggcgugagaugcuuucu

SEQ ID NO: 11278 - RNA, 20 nt, Artificial Sequence
  spacer sequence
aauaaaacauuuauagauaa

SEQ ID NO: 11279 - RNA, 20 nt, Artificial Sequence
  spacer sequence
auaaauguuuuauuggacuc

SEQ ID NO: 11280 - RNA, 20 nt, Artificial Sequence
  spacer sequence
uaucuauaaauguuuuauug

SEQ ID NO: 11281 - RNA, 20 nt, Artificial Sequence
  spacer sequence
uaaauucuuaucuauaaaug

SEQ ID NO: 11282 - RNA, 20 nt, Artificial Sequence
  spacer sequence
cuuaaauucuuaucuauaaa

SEQ ID NO: 11283 - RNA, 20 nt, Artificial Sequence
  spacer sequence
uucuguuuuuuguuuguuug

SEQ ID NO: 11284 - RNA, 20 nt, Artificial Sequence
  spacer sequence
guuuuuuguuuguuuguuug

SEQ ID NO: 11285 - RNA, 20 nt, Artificial Sequence
  spacer sequence
cccuguguugcccaggcugg

SEQ ID NO: 11286 - RNA, 20 nt, Artificial Sequence
  spacer sequence
cuguguugcccaggcugguc

SEQ ID NO: 11287 - RNA, 20 nt, Artificial Sequence
  spacer sequence
ugaacuccugggcucaggca

SEQ ID NO: 11288 - RNA, 20 nt, Artificial Sequence
  spacer sequence
agaccagccugggcaacaca

SEQ ID NO: 11289 - RNA, 20 nt, Artificial Sequence
  spacer sequence
ugggcucaggcaauucuucc

SEQ ID NO: 11290 - RNA, 20 nt, Artificial Sequence
  spacer sequence
ggcaauucuuccaucucagc

SEQ ID NO: 11291 - RNA, 20 nt, Artificial Sequence
  spacer sequence
uccaucucagccucgcagag

SEQ ID NO: 11292 - RNA, 20 nt, Artificial Sequence
  spacer sequence
aucucagccucgcagaguuc

SEQ ID NO: 11293 - RNA, 20 nt, Artificial Sequence
  spacer sequence
cagccucgcagaguucuagg

SEQ ID NO: 11294 - RNA, 20 nt, Artificial Sequence
  spacer sequence
gccucgcagaguucuaggau

SEQ ID NO: 11295 - RNA, 20 nt, Artificial Sequence
  spacer sequence
cagaguucuaggauuacagg

SEQ ID NO: 11296 - RNA, 20 nt, Artificial Sequence
  spacer sequence
gcgaggcugagauggaagaa

SEQ ID NO: 11297 - RNA, 20 nt, Artificial Sequence
  spacer sequence
aggauuacaggcaugagcca

SEQ ID NO: 11298 - RNA, 20 nt, Artificial Sequence
  spacer sequence
uagaacucugcgaggcugag

SEQ ID NO: 11299 - RNA, 20 nt, Artificial Sequence
  spacer sequence
ugccuguaauccuagaacuc

SEQ ID NO: 11300 - RNA, 20 nt, Artificial Sequence
  spacer sequence
acaaacaaauuuaaaauuag

SEQ ID NO: 11301 - RNA, 20 nt, Artificial Sequence
  spacer sequence
uccuauguuguccaggcugg

SEQ ID NO: 11302 - RNA, 20 nt, Artificial Sequence
  spacer sequence
uauguuguccaggcuggucu

SEQ ID NO: 11303 - RNA, 20 nt, Artificial Sequence
  spacer sequence
aggcuggucuucaacuccug

SEQ ID NO: 11304 - RNA, 20 nt, Artificial Sequence
  spacer sequence
ucaacuccuguucuuaagca

SEQ ID NO: 11305 - RNA, 20 nt, Artificial Sequence
  spacer sequence
acuccuguucuuaagcaauc

SEQ ID NO: 11306 - RNA, 20 nt, Artificial Sequence
  spacer sequence
uguucuuaagcaauccuccu

SEQ ID NO: 11307 - RNA, 20 nt, Artificial Sequence
  spacer sequence
uaagcaauccuccugccucg

SEQ ID NO: 11308 - RNA, 20 nt, Artificial Sequence
  spacer sequence
uccugccucggccucccaaa

SEQ ID NO: 11309 - RNA, 20 nt, Artificial Sequence
  spacer sequence
ugccucggccucccaaagug

SEQ ID NO: 11310 - RNA, 20 nt, Artificial Sequence
  spacer sequence
gccucccaaaguguugggaa

SEQ ID NO: 11311 - RNA, 20 nt, Artificial Sequence
  spacer sequence
caaaguguugggaauauggg

SEQ ID NO: 11312 - RNA, 20 nt, Artificial Sequence
  spacer sequence
caacacuuugggaggccgag

SEQ ID NO: 11313 - RNA, 20 nt, Artificial Sequence
  spacer sequence
cacccauauucccaacacuu

SEQ ID NO: 11314 - RNA, 20 nt, Artificial Sequence
  spacer sequence
uauucccacccauauuccca

SEQ ID NO: 11315 - RNA, 20 nt, Artificial Sequence
  spacer sequence
aggcugggugcaguggcuca

SEQ ID NO: 11316 - RNA, 20 nt, Artificial Sequence
  spacer sequence
uuuucaaggcugggugcagu

SEQ ID NO: 11317 - RNA, 20 nt, Artificial Sequence
  spacer sequence
uucuaaugcuuuaugccaua

SEQ ID NO: 11318 - RNA, 20 nt, Artificial Sequence
  spacer sequence
aaugcuuuaugccauauacu

SEQ ID NO: 11319 - RNA, 20 nt, Artificial Sequence
  spacer sequence
ccagaaaguauauggcauaa

SEQ ID NO: 11320 - RNA, 20 nt, Artificial Sequence
  spacer sequence
cuccagaaaguauauggcau

SEQ ID NO: 11321 - RNA, 20 nt, Artificial Sequence
  spacer sequence
uauaauacagccaguuuaua

SEQ ID NO: 11322 - RNA, 20 nt, Artificial Sequence
  spacer sequence
cauauaauacagccaguuua

SEQ ID NO: 11323 - RNA, 20 nt, Artificial Sequence
  spacer sequence
uucuccuuggucugcuuucc

SEQ ID NO: 11324 - RNA, 20 nt, Artificial Sequence
  spacer sequence
ccuuggucugcuuuccuucu

SEQ ID NO: 11325 - RNA, 20 nt, Artificial Sequence
  spacer sequence
uuggucugcuuuccuucucu

SEQ ID NO: 11326 - RNA, 20 nt, Artificial Sequence
  spacer sequence
gcuuuccuucucuggccagc

SEQ ID NO: 11327 - RNA, 20 nt, Artificial Sequence
  spacer sequence
uucucuggccagccuccugg

SEQ ID NO: 11328 - RNA, 20 nt, Artificial Sequence
  spacer sequence
cuggccagccuccuggauuc

SEQ ID NO: 11329 - RNA, 20 nt, Artificial Sequence
  spacer sequence
ggccagccuccuggauucaa

SEQ ID NO: 11330 - RNA, 20 nt, Artificial Sequence
  spacer sequence
uggauucaagucauuuguca

SEQ ID NO: 11331 - RNA, 20 nt, Artificial Sequence
  spacer sequence
aggaggcuggccagagaagg

SEQ ID NO: 11332 - RNA, 20 nt, Artificial Sequence
  spacer sequence
agucauuugucagauaugug

SEQ ID NO: 11333 - RNA, 20 nt, Artificial Sequence
  spacer sequence
ccugguuuagaacugcauuu

SEQ ID NO: 11334 - RNA, 20 nt, Artificial Sequence
  spacer sequence
ugguuuagaacugcauuuca

SEQ ID NO: 11335 - RNA, 20 nt, Artificial Sequence
  spacer sequence
aaaccaggagagaguucagu

SEQ ID NO: 11336 - RNA, 20 nt, Artificial Sequence
  spacer sequence
acugcccacuggggaauucc

SEQ ID NO: 11337 - RNA, 20 nt, Artificial Sequence
  spacer sequence
ccagugggcaguugaaaugc

SEQ ID NO: 11338 - RNA, 20 nt, Artificial Sequence
  spacer sequence
acauggggaucccuccaucc

SEQ ID NO: 11339 - RNA, 20 nt, Artificial Sequence
  spacer sequence
ccauguggaauuccccagug

SEQ ID NO: 11340 - RNA, 20 nt, Artificial Sequence
  spacer sequence
cuccauccccaagggaccca

SEQ ID NO: 11341 - RNA, 20 nt, Artificial Sequence
  spacer sequence
auccccaagggacccaccug

SEQ ID NO: 11342 - RNA, 20 nt, Artificial Sequence
  spacer sequence
ccaagggacccaccugacuc

SEQ ID NO: 11343 - RNA, 20 nt, Artificial Sequence
  spacer sequence
cuuggggauggagggauccc

SEQ ID NO: 11344 - RNA, 20 nt, Artificial Sequence
  spacer sequence
ggugggucccuuggggaugg

SEQ ID NO: 11345 - RNA, 20 nt, Artificial Sequence
  spacer sequence
uuuugugcaucuucugucuu

SEQ ID NO: 11346 - RNA, 20 nt, Artificial Sequence
  spacer sequence
ucugucuucaugcccuuuau

SEQ ID NO: 11347 - RNA, 20 nt, Artificial Sequence
  spacer sequence
gucuucaugcccuuuauguu

SEQ ID NO: 11348 - RNA, 20 nt, Artificial Sequence
  spacer sequence
ucaugcccuuuauguuguug

SEQ ID NO: 11349 - RNA, 20 nt, Artificial Sequence
  spacer sequence
ugcccuuuauguuguugggg

SEQ ID NO: 11350 - RNA, 20 nt, Artificial Sequence
  spacer sequence
auuguuuuggccccaacaac

SEQ ID NO: 11351 - RNA, 20 nt, Artificial Sequence
  spacer sequence
uuccauuguuuuggccccaa

SEQ ID NO: 11352 - RNA, 20 nt, Artificial Sequence
  spacer sequence
aagaaggaagagcucaacgg

SEQ ID NO: 11353 - RNA, 20 nt, Artificial Sequence
  spacer sequence
uggaguuccugcuuuccaca

SEQ ID NO: 11354 - RNA, 20 nt, Artificial Sequence
  spacer sequence
uucuuggaguuccugcuuuc

SEQ ID NO: 11355 - RNA, 20 nt, Artificial Sequence
  spacer sequence
uccuucuuggaguuccugcu

SEQ ID NO: 11356 - RNA, 20 nt, Artificial Sequence
  spacer sequence
acggcaguugggcaauggga

SEQ ID NO: 11357 - RNA, 20 nt, Artificial Sequence
  spacer sequence
cauugcccaacugccguuga

SEQ ID NO: 11358 - RNA, 20 nt, Artificial Sequence
  spacer sequence
cuaaaaucccauugcccaac

SEQ ID NO: 11359 - RNA, 20 nt, Artificial Sequence
  spacer sequence
uuuucuuuuuaauuuuucag

SEQ ID NO: 11360 - RNA, 20 nt, Artificial Sequence
  spacer sequence
uuuuaauuuuucagcauuuu

SEQ ID NO: 11361 - RNA, 20 nt, Artificial Sequence
  spacer sequence
gcauuuuucauacuccucac

SEQ ID NO: 11362 - RNA, 20 nt, Artificial Sequence
  spacer sequence
uacuccucacagaaggcaug

SEQ ID NO: 11363 - RNA, 20 nt, Artificial Sequence
  spacer sequence
ucacagaaggcauguaucac

SEQ ID NO: 11364 - RNA, 20 nt, Artificial Sequence
  spacer sequence
cagaaggcauguaucacuuu

SEQ ID NO: 11365 - RNA, 20 nt, Artificial Sequence
  spacer sequence
cuucaucacuuccuaucuua

SEQ ID NO: 11366 - RNA, 20 nt, Artificial Sequence
  spacer sequence
ucaucacuuccuaucuuacu

SEQ ID NO: 11367 - RNA, 20 nt, Artificial Sequence
  spacer sequence
ucacuuccuaucuuacuuag

SEQ ID NO: 11368 - RNA, 20 nt, Artificial Sequence
  spacer sequence
cuuccuaucuuacuuaggau

SEQ ID NO: 11369 - RNA, 20 nt, Artificial Sequence
  spacer sequence
uaucuuacuuaggauuagga

SEQ ID NO: 11370 - RNA, 20 nt, Artificial Sequence
  spacer sequence
uacuuaggauuaggaaucca

SEQ ID NO: 11371 - RNA, 20 nt, Artificial Sequence
  spacer sequence
uaaguaagauaggaagugau

SEQ ID NO: 11372 - RNA, 20 nt, Artificial Sequence
  spacer sequence
uaauccuaaguaagauagga

SEQ ID NO: 11373 - RNA, 20 nt, Artificial Sequence
  spacer sequence
aagauucucuuuccaaaaug

SEQ ID NO: 11374 - RNA, 20 nt, Artificial Sequence
  spacer sequence
uggauuccuaauccuaagua

SEQ ID NO: 11375 - RNA, 20 nt, Artificial Sequence
  spacer sequence
cuuuccaaaauggaaaguau

SEQ ID NO: 11376 - RNA, 20 nt, Artificial Sequence
  spacer sequence
uuccaaaauggaaaguauua

SEQ ID NO: 11377 - RNA, 20 nt, Artificial Sequence
  spacer sequence
aaaauggaaaguauuaaaaa

SEQ ID NO: 11378 - RNA, 20 nt, Artificial Sequence
  spacer sequence
auuuuggaaagagaaucuug

SEQ ID NO: 11379 - RNA, 20 nt, Artificial Sequence
  spacer sequence
acacaccuagcacagugccu

SEQ ID NO: 11380 - RNA, 20 nt, Artificial Sequence
  spacer sequence
caguauuccacacaccuagc

SEQ ID NO: 11381 - RNA, 20 nt, Artificial Sequence
  spacer sequence
guguuugggcuuaucacagu

SEQ ID NO: 11382 - RNA, 20 nt, Artificial Sequence
  spacer sequence
uuccucgaggaacuauuccu

SEQ ID NO: 11383 - RNA, 20 nt, Artificial Sequence
  spacer sequence
ucgaggaacuauuccuccag

SEQ ID NO: 11384 - RNA, 20 nt, Artificial Sequence
  spacer sequence
aggaacuauuccuccagagu

SEQ ID NO: 11385 - RNA, 20 nt, Artificial Sequence
  spacer sequence
aggaaggaacuuaucugugu

SEQ ID NO: 11386 - RNA, 20 nt, Artificial Sequence
  spacer sequence
ucgaggaaggaacuuaucug

SEQ ID NO: 11387 - RNA, 20 nt, Artificial Sequence
  spacer sequence
uccagagucuggcaccuugc

SEQ ID NO: 11388 - RNA, 20 nt, Artificial Sequence
  spacer sequence
gauauguguguuguaaacau

SEQ ID NO: 11389 - RNA, 20 nt, Artificial Sequence
  spacer sequence
gacaaaggacucauaucauu

SEQ ID NO: 11390 - RNA, 20 nt, Artificial Sequence
  spacer sequence
ucacagucuguggcuuuccu

SEQ ID NO: 11391 - RNA, 20 nt, Artificial Sequence
  spacer sequence
cagucuguggcuuuccuuuu

SEQ ID NO: 11392 - RNA, 20 nt, Artificial Sequence
  spacer sequence
guggcuuuccuuuucauuuu

SEQ ID NO: 11393 - RNA, 20 nt, Artificial Sequence
  spacer sequence
uuuucauuuucuuuugaaaa

SEQ ID NO: 11394 - RNA, 20 nt, Artificial Sequence
  spacer sequence
uuuucuuuugaaaagcagau

SEQ ID NO: 11395 - RNA, 20 nt, Artificial Sequence
  spacer sequence
uuugaaaagcagauguuuuu

SEQ ID NO: 11396 - RNA, 20 nt, Artificial Sequence
  spacer sequence
aaagaaaaugaaaaggaaag

SEQ ID NO: 11397 - RNA, 20 nt, Artificial Sequence
  spacer sequence
gcuuuucaaaagaaaaugaa

SEQ ID NO: 11398 - RNA, 20 nt, Artificial Sequence
  spacer sequence
aaauuaaaaacaucugcuuu

SEQ ID NO: 11399 - RNA, 20 nt, Artificial Sequence
  spacer sequence
aucaaaauuaaaaacaucug

SEQ ID NO: 11400 - RNA, 20 nt, Artificial Sequence
  spacer sequence
uuuaugguuugugcuuuucu

SEQ ID NO: 11401 - RNA, 20 nt, Artificial Sequence
  spacer sequence
gucauauugaaaaauuuuug

SEQ ID NO: 11402 - RNA, 20 nt, Artificial Sequence
  spacer sequence
uauugaaaaauuuuugcuua

SEQ ID NO: 11403 - RNA, 20 nt, Artificial Sequence
  spacer sequence
auaugacagaaaagcacaaa

SEQ ID NO: 11404 - RNA, 20 nt, Artificial Sequence
  spacer sequence
ccaggauauggaaauguucu

SEQ ID NO: 11405 - RNA, 20 nt, Artificial Sequence
  spacer sequence
uggggauaagcaaaaauuuu

SEQ ID NO: 11406 - RNA, 20 nt, Artificial Sequence
  spacer sequence
auauccuggggauaagcaaa

SEQ ID NO: 11407 - RNA, 20 nt, Artificial Sequence
  spacer sequence
ccucuauuuucuucuugacu

SEQ ID NO: 11408 - RNA, 20 nt, Artificial Sequence
  spacer sequence
ucuauuuucuucuugacucu

SEQ ID NO: 11409 - RNA, 20 nt, Artificial Sequence
  spacer sequence
auuuucuucuugacucuuua

SEQ ID NO: 11410 - RNA, 20 nt, Artificial Sequence
  spacer sequence
ucuugacucuuuauagcuua

SEQ ID NO: 11411 - RNA, 20 nt, Artificial Sequence
  spacer sequence
ugacucuuuauagcuuagca

SEQ ID NO: 11412 - RNA, 20 nt, Artificial Sequence
  spacer sequence
agaagaaaauagaggagaac

SEQ ID NO: 11413 - RNA, 20 nt, Artificial Sequence
  spacer sequence
uuauagcuuagcacuuuugu

SEQ ID NO: 11414 - RNA, 20 nt, Artificial Sequence
  spacer sequence
gugauccauuuugauuuaau

SEQ ID NO: 11415 - RNA, 20 nt, Artificial Sequence
  spacer sequence
cagacuuaaacaaaagugcu

SEQ ID NO: 11416 - RNA, 20 nt, Artificial Sequence
  spacer sequence
agcuucauuuuuuuacauua

SEQ ID NO: 11417 - RNA, 20 nt, Artificial Sequence
  spacer sequence
uuuuuuuacauuaggauauc

SEQ ID NO: 11418 - RNA, 20 nt, Artificial Sequence
  spacer sequence
uaauguaaaaaaaugaagcu

SEQ ID NO: 11419 - RNA, 20 nt, Artificial Sequence
  spacer sequence
aguuguuccagcacuauuug

SEQ ID NO: 11420 - RNA, 20 nt, Artificial Sequence
  spacer sequence
agcacuauuuguuggaaaaa

SEQ ID NO: 11421 - RNA, 20 nt, Artificial Sequence
  spacer sequence
aacaaauagugcuggaacaa

SEQ ID NO: 11422 - RNA, 20 nt, Artificial Sequence
  spacer sequence
uuuuuuccaacaaauagugc

SEQ ID NO: 11423 - RNA, 20 nt, Artificial Sequence
  spacer sequence
uuucccccauugaauuacuu

SEQ ID NO: 11424 - RNA, 20 nt, Artificial Sequence
  spacer sequence
cccauugaauuacuuugccu

SEQ ID NO: 11425 - RNA, 20 nt, Artificial Sequence
  spacer sequence
uugcaaauugaacccggcaa

SEQ ID NO: 11426 - RNA, 20 nt, Artificial Sequence
  spacer sequence
gucugucaaaauauuuccuu

SEQ ID NO: 11427 - RNA, 20 nt, Artificial Sequence
  spacer sequence
gucaaaauauuuccuucuau

SEQ ID NO: 11428 - RNA, 20 nt, Artificial Sequence
  spacer sequence
aaauauuuccuucuauauuc

SEQ ID NO: 11429 - RNA, 20 nt, Artificial Sequence
  spacer sequence
uucuauauucaugaguggua

SEQ ID NO: 11430 - RNA, 20 nt, Artificial Sequence
  spacer sequence
auauucaugagugguauugg

SEQ ID NO: 11431 - RNA, 20 nt, Artificial Sequence
  spacer sequence
ugagugguauugguggucuc

SEQ ID NO: 11432 - RNA, 20 nt, Artificial Sequence
  spacer sequence
ugaauauagaaggaaauauu

SEQ ID NO: 11433 - RNA, 20 nt, Artificial Sequence
  spacer sequence
cuguuuuccuuuucuuguaa

SEQ ID NO: 11434 - RNA, 20 nt, Artificial Sequence
  spacer sequence
guuuuccuuuucuuguaaug

SEQ ID NO: 11435 - RNA, 20 nt, Artificial Sequence
  spacer sequence
uuuucuuguaaugguuuugg

SEQ ID NO: 11436 - RNA, 20 nt, Artificial Sequence
  spacer sequence
uguaaugguuuuggugucgg

SEQ ID NO: 11437 - RNA, 20 nt, Artificial Sequence
  spacer sequence
ggguagcuugcucucaucaa

SEQ ID NO: 11438 - RNA, 20 nt, Artificial Sequence
  spacer sequence
caucaaauuauuugauaagu

SEQ ID NO: 11439 - RNA, 20 nt, Artificial Sequence
  spacer sequence
ucaaauuauuugauaagugc

SEQ ID NO: 11440 - RNA, 20 nt, Artificial Sequence
  spacer sequence
aauuauuugauaagugcuuc

SEQ ID NO: 11441 - RNA, 20 nt, Artificial Sequence
  spacer sequence
uucucuauuuucuaaaauag

SEQ ID NO: 11442 - RNA, 20 nt, Artificial Sequence
  spacer sequence
cuauuuucuaaaauagccug

SEQ ID NO: 11443 - RNA, 20 nt, Artificial Sequence
  spacer sequence
auuuucuaaaauagccugug

SEQ ID NO: 11444 - RNA, 20 nt, Artificial Sequence
  spacer sequence
aaaauagccuguguggaauu

SEQ ID NO: 11445 - RNA, 20 nt, Artificial Sequence
  spacer sequence
acacaggcuauuuuagaaaa

SEQ ID NO: 11446 - RNA, 20 nt, Artificial Sequence
  spacer sequence
auuccacacaggcuauuuua

SEQ ID NO: 11447 - RNA, 20 nt, Artificial Sequence
  spacer sequence
uucuuaagauuuguuagaau

SEQ ID NO: 11448 - RNA, 20 nt, Artificial Sequence
  spacer sequence
uaagauuuguuagaauucac

SEQ ID NO: 11449 - RNA, 20 nt, Artificial Sequence
  spacer sequence
uaagaaagaaauaauaucaa

SEQ ID NO: 11450 - RNA, 20 nt, Artificial Sequence
  spacer sequence
aacaaaucuuaagaaagaaa

SEQ ID NO: 11451 - RNA, 20 nt, Artificial Sequence
  spacer sequence
ccaaugaagccacuugggcc

SEQ ID NO: 11452 - RNA, 20 nt, Artificial Sequence
  spacer sequence
uuggugaauucuaacaaauc

SEQ ID NO: 11453 - RNA, 20 nt, Artificial Sequence
  spacer sequence
caaauuuuggaguguuguau

SEQ ID NO: 11454 - RNA, 20 nt, Artificial Sequence
  spacer sequence
aauuuuggaguguuguauuu

SEQ ID NO: 11455 - RNA, 20 nt, Artificial Sequence
  spacer sequence
aaaauuugagaaguaaauuu

SEQ ID NO: 11456 - RNA, 20 nt, Artificial Sequence
  spacer sequence
uaaauauuuaguucaaaaua

SEQ ID NO: 11457 - RNA, 20 nt, Artificial Sequence
  spacer sequence
aaauauuuuguaauuucccu

SEQ ID NO: 11458 - RNA, 20 nt, Artificial Sequence
  spacer sequence
uucugugauugauuauacua

SEQ ID NO: 11459 - RNA, 20 nt, Artificial Sequence
  spacer sequence
gugauugauuauacuaaucg

SEQ ID NO: 11460 - RNA, 20 nt, Artificial Sequence
  spacer sequence
cagaaagauaacagaaauuc

SEQ ID NO: 11461 - RNA, 20 nt, Artificial Sequence
  spacer sequence
aucacagaaagauaacagaa

SEQ ID NO: 11462 - RNA, 20 nt, Artificial Sequence
  spacer sequence
aauuccauuauagucacaua

SEQ ID NO: 11463 - RNA, 20 nt, Artificial Sequence
  spacer sequence
auuaguauaaucaaucacag

SEQ ID NO: 11464 - RNA, 20 nt, Artificial Sequence
  spacer sequence
auuauagucacauaucauac

SEQ ID NO: 11465 - RNA, 20 nt, Artificial Sequence
  spacer sequence
cauaucauacuucauaugau

SEQ ID NO: 11466 - RNA, 20 nt, Artificial Sequence
  spacer sequence
uacuucauaugauuucaguu

SEQ ID NO: 11467 - RNA, 20 nt, Artificial Sequence
  spacer sequence
uaugauuucaguuuuuuuuu

SEQ ID NO: 11468 - RNA, 20 nt, Artificial Sequence
  spacer sequence
uaugaaguaugauaugugac

SEQ ID NO: 11469 - RNA, 20 nt, Artificial Sequence
  spacer sequence
guuuuuuuuuaauuauugug

SEQ ID NO: 11470 - RNA, 20 nt, Artificial Sequence
  spacer sequence
caauaauuaaaaaaaaacug

SEQ ID NO: 11471 - RNA, 20 nt, Artificial Sequence
  spacer sequence
auucauggucuaccuagaug

SEQ ID NO: 11472 - RNA, 20 nt, Artificial Sequence
  spacer sequence
uggucuaccuagaugauugc

SEQ ID NO: 11473 - RNA, 20 nt, Artificial Sequence
  spacer sequence
auucuuuuucuaccugcuua

SEQ ID NO: 11474 - RNA, 20 nt, Artificial Sequence
  spacer sequence
uuuucuaccugcuuauuaug

SEQ ID NO: 11475 - RNA, 20 nt, Artificial Sequence
  spacer sequence
accugcuuauuaugucaauu

SEQ ID NO: 11476 - RNA, 20 nt, Artificial Sequence
  spacer sequence
auuagagaggagauuugaug

SEQ ID NO: 11477 - RNA, 20 nt, Artificial Sequence
  spacer sequence
aauugacauaauaagcaggu

SEQ ID NO: 11478 - RNA, 20 nt, Artificial Sequence
  spacer sequence
cuaauugacauaauaagcag

SEQ ID NO: 11479 - RNA, 20 nt, Artificial Sequence
  spacer sequence
ucucuaauugacauaauaag

SEQ ID NO: 11480 - RNA, 20 nt, Artificial Sequence
  spacer sequence
ccucucuaauugacauaaua

SEQ ID NO: 11481 - RNA, 20 nt, Artificial Sequence
  spacer sequence
aaucuccucucuaauugaca

SEQ ID NO: 11482 - RNA, 20 nt, Artificial Sequence
  spacer sequence
ccugaugugauugugcaugu

SEQ ID NO: 11483 - RNA, 20 nt, Artificial Sequence
  spacer sequence
ugaugugauugugcauguau

SEQ ID NO: 11484 - RNA, 20 nt, Artificial Sequence
  spacer sequence
ggagacaucaaaucuccucu

SEQ ID NO: 11485 - RNA, 20 nt, Artificial Sequence
  spacer sequence
caucaggagacaucaaaucu

SEQ ID NO: 11486 - RNA, 20 nt, Artificial Sequence
  spacer sequence
ccuuucaauagcuuugugua

SEQ ID NO: 11487 - RNA, 20 nt, Artificial Sequence
  spacer sequence
uuucaauagcuuuguguauu

SEQ ID NO: 11488 - RNA, 20 nt, Artificial Sequence
  spacer sequence
auagcuuuguguauuuuuuu

SEQ ID NO: 11489 - RNA, 20 nt, Artificial Sequence
  spacer sequence
ggcugacucauguauauuga

SEQ ID NO: 11490 - RNA, 20 nt, Artificial Sequence
  spacer sequence
gccagacgcaguggcucaca

SEQ ID NO: 11491 - RNA, 20 nt, Artificial Sequence
  spacer sequence
uguauauugaagcuuuguua

SEQ ID NO: 11492 - RNA, 20 nt, Artificial Sequence
  spacer sequence
auauacaugagucagccaga

SEQ ID NO: 11493 - RNA, 20 nt, Artificial Sequence
  spacer sequence
ccuugaugaauagacuccuu

SEQ ID NO: 11494 - RNA, 20 nt, Artificial Sequence
  spacer sequence
uugaugaauagacuccuuau

SEQ ID NO: 11495 - RNA, 20 nt, Artificial Sequence
  spacer sequence
aggagaaauaauaaugcuaa

SEQ ID NO: 11496 - RNA, 20 nt, Artificial Sequence
  spacer sequence
ucaaggagaaauaauaaugc

SEQ ID NO: 11497 - RNA, 20 nt, Artificial Sequence
  spacer sequence
auucaucaaggagaaauaau

SEQ ID NO: 11498 - RNA, 20 nt, Artificial Sequence
  spacer sequence
uuaucaauuggaaaauuuuc

SEQ ID NO: 11499 - RNA, 20 nt, Artificial Sequence
  spacer sequence
auuggaaaauuuucucuuuu

SEQ ID NO: 11500 - RNA, 20 nt, Artificial Sequence
  spacer sequence
aauugauaaggagucuauuc

SEQ ID NO: 11501 - RNA, 20 nt, Artificial Sequence
  spacer sequence
cuuuuuucugguaacauucc

SEQ ID NO: 11502 - RNA, 20 nt, Artificial Sequence
  spacer sequence
uuuuucugguaacauuccuu

SEQ ID NO: 11503 - RNA, 20 nt, Artificial Sequence
  spacer sequence
acaaaaaaauccacuuuaaa

SEQ ID NO: 11504 - RNA, 20 nt, Artificial Sequence
  spacer sequence
guccauucugacaugucuga

SEQ ID NO: 11505 - RNA, 20 nt, Artificial Sequence
  spacer sequence
auucugacaugucugacuua

SEQ ID NO: 11506 - RNA, 20 nt, Artificial Sequence
  spacer sequence
gacaugucugacuuaacuga

SEQ ID NO: 11507 - RNA, 20 nt, Artificial Sequence
  spacer sequence
gaauggacugaaaugcaagg

SEQ ID NO: 11508 - RNA, 20 nt, Artificial Sequence
  spacer sequence
gacuuaacugaauuguuuag

SEQ ID NO: 11509 - RNA, 20 nt, Artificial Sequence
  spacer sequence
gacaugucagaauggacuga

SEQ ID NO: 11510 - RNA, 20 nt, Artificial Sequence
  spacer sequence
guuaagucagacaugucaga

SEQ ID NO: 11511 - RNA, 20 nt, Artificial Sequence
  spacer sequence
aaacaauucaguuaagucag

SEQ ID NO: 11512 - RNA, 20 nt, Artificial Sequence
  spacer sequence
cauuuaauguaguugucaau

SEQ ID NO: 11513 - RNA, 20 nt, Artificial Sequence
  spacer sequence
auaggguugaguuucauucu

SEQ ID NO: 11514 - RNA, 20 nt, Artificial Sequence
  spacer sequence
acccuauugacaacuacauu

SEQ ID NO: 11515 - RNA, 20 nt, Artificial Sequence
  spacer sequence
uucuaccauuuugcugucug

SEQ ID NO: 11516 - RNA, 20 nt, Artificial Sequence
  spacer sequence
accauuuugcugucuguuuu

SEQ ID NO: 11517 - RNA, 20 nt, Artificial Sequence
  spacer sequence
guuuucgguuuguccugucu

SEQ ID NO: 11518 - RNA, 20 nt, Artificial Sequence
  spacer sequence
guuuguccugucugcucuac

SEQ ID NO: 11519 - RNA, 20 nt, Artificial Sequence
  spacer sequence
ugucugcucuacuauuuuuc

SEQ ID NO: 11520 - RNA, 20 nt, Artificial Sequence
  spacer sequence
gcucuacuauuuuucucuuc

SEQ ID NO: 11521 - RNA, 20 nt, Artificial Sequence
  spacer sequence
acuauuuuucucuucauuug

SEQ ID NO: 11522 - RNA, 20 nt, Artificial Sequence
  spacer sequence
cuucauuuggcuuuuuuugg

SEQ ID NO: 11523 - RNA, 20 nt, Artificial Sequence
  spacer sequence
cagcuacucaagaggcugag

SEQ ID NO: 11524 - RNA, 20 nt, Artificial Sequence
  spacer sequence
agaggcugaggcaggagaau

SEQ ID NO: 11525 - RNA, 20 nt, Artificial Sequence
  spacer sequence
ugaguagcugggauuacagg

SEQ ID NO: 11526 - RNA, 20 nt, Artificial Sequence
  spacer sequence
gccucuugaguagcugggau

SEQ ID NO: 11527 - RNA, 20 nt, Artificial Sequence
  spacer sequence
ugccucagccucuugaguag

SEQ ID NO: 11528 - RNA, 20 nt, Artificial Sequence
  spacer sequence
ccugccucagccucuugagu

SEQ ID NO: 11529 - RNA, 20 nt, Artificial Sequence
  spacer sequence
agcaauucuccugccucagc

SEQ ID NO: 11530 - RNA, 20 nt, Artificial Sequence
  spacer sequence
uggguucaagcaauucuccu

SEQ ID NO: 11531 - RNA, 20 nt, Artificial Sequence
  spacer sequence
cccuccuggguucaagcaau

SEQ ID NO: 11532 - RNA, 20 nt, Artificial Sequence
  spacer sequence
cugcaaccucccccuccugg

SEQ ID NO: 11533 - RNA, 20 nt, Artificial Sequence
  spacer sequence
gcucacugcaaccucccccu

SEQ ID NO: 11534 - RNA, 20 nt, Artificial Sequence
  spacer sequence
cggcucacugcaaccucccc

SEQ ID NO: 11535 - RNA, 20 nt, Artificial Sequence
  spacer sequence
cgccacugcacuccagccug

SEQ ID NO: 11536 - RNA, 20 nt, Artificial Sequence
  spacer sequence
agccugggcaacagagcaag

SEQ ID NO: 11537 - RNA, 20 nt, Artificial Sequence
  spacer sequence
guugcccaggcuggagugca

SEQ ID NO: 11538 - RNA, 20 nt, Artificial Sequence
  spacer sequence
ugcucuguugcccaggcugg

SEQ ID NO: 11539 - RNA, 20 nt, Artificial Sequence
  spacer sequence
gucucaaaaaaaaaaaaaau

SEQ ID NO: 11540 - RNA, 20 nt, Artificial Sequence
  spacer sequence
caaaaaaaaaaaaaauuuuu

SEQ ID NO: 11541 - RNA, 20 nt, Artificial Sequence
  spacer sequence
aaaaaaaaaaaaauuuuugu

SEQ ID NO: 11542 - RNA, 20 nt, Artificial Sequence
  spacer sequence
gcugucagugaaaccucucu

SEQ ID NO: 11543 - RNA, 20 nt, Artificial Sequence
  spacer sequence
gugaaaccucucuguucuug

SEQ ID NO: 11544 - RNA, 20 nt, Artificial Sequence
  spacer sequence
cugacagcagaugugcacua

SEQ ID NO: 11545 - RNA, 20 nt, Artificial Sequence
  spacer sequence
cuguucuuguugaucugaaa

SEQ ID NO: 11546 - RNA, 20 nt, Artificial Sequence
  spacer sequence
guucuuguugaucugaaaaa

SEQ ID NO: 11547 - RNA, 20 nt, Artificial Sequence
  spacer sequence
uguugaucugaaaaagucua

SEQ ID NO: 11548 - RNA, 20 nt, Artificial Sequence
  spacer sequence
acaagaacagagagguuuca

SEQ ID NO: 11549 - RNA, 20 nt, Artificial Sequence
  spacer sequence
gaaaaagucuauauuuuacc

SEQ ID NO: 11550 - RNA, 20 nt, Artificial Sequence
  spacer sequence
gaucaacaagaacagagagg

SEQ ID NO: 11551 - RNA, 20 nt, Artificial Sequence
  spacer sequence
auauuuuaccugaaauucug

SEQ ID NO: 11552 - RNA, 20 nt, Artificial Sequence
  spacer sequence
gguaaaauauagacuuuuuc

SEQ ID NO: 11553 - RNA, 20 nt, Artificial Sequence
  spacer sequence
gaaagggauuuucugugggu

SEQ ID NO: 11554 - RNA, 20 nt, Artificial Sequence
  spacer sequence
gaauuucagguaaaauauag

SEQ ID NO: 11555 - RNA, 20 nt, Artificial Sequence
  spacer sequence
cuuucagaauuucagguaaa

SEQ ID NO: 11556 - RNA, 20 nt, Artificial Sequence
  spacer sequence
guggguauagaauucuacau

SEQ ID NO: 11557 - RNA, 20 nt, Artificial Sequence
  spacer sequence
auacccacagaaaaucccuu

SEQ ID NO: 11558 - RNA, 20 nt, Artificial Sequence
  spacer sequence
acauuuacaggguuugcccc

SEQ ID NO: 11559 - RNA, 20 nt, Artificial Sequence
  spacer sequence
agugcuagguaaggggcaaa

SEQ ID NO: 11560 - RNA, 20 nt, Artificial Sequence
  spacer sequence
uuccauuguuuucuggcuug

SEQ ID NO: 11561 - RNA, 20 nt, Artificial Sequence
  spacer sequence
auuguuuucuggcuugcaua

SEQ ID NO: 11562 - RNA, 20 nt, Artificial Sequence
  spacer sequence
ggcuugcauaguuucucaug

SEQ ID NO: 11563 - RNA, 20 nt, Artificial Sequence
  spacer sequence
uauauuuguaaauaauugcc

SEQ ID NO: 11564 - RNA, 20 nt, Artificial Sequence
  spacer sequence
aaugucugaaaauuguuauu

SEQ ID NO: 11565 - RNA, 20 nt, Artificial Sequence
  spacer sequence
gaaaauuguuauuuccugua

SEQ ID NO: 11566 - RNA, 20 nt, Artificial Sequence
  spacer sequence
gacauuggacaaaaggcaau

SEQ ID NO: 11567 - RNA, 20 nt, Artificial Sequence
  spacer sequence
uguauauuuuccaguuuucu

SEQ ID NO: 11568 - RNA, 20 nt, Artificial Sequence
  spacer sequence
aguuuucugguuuguuucuu

SEQ ID NO: 11569 - RNA, 20 nt, Artificial Sequence
  spacer sequence
gguuuguuucuuuuuuaugg

SEQ ID NO: 11570 - RNA, 20 nt, Artificial Sequence
  spacer sequence
uuuuuauggugaaaugguaa

SEQ ID NO: 11571 - RNA, 20 nt, Artificial Sequence
  spacer sequence
ccauaaaaaagaaacaaacc

SEQ ID NO: 11572 - RNA, 20 nt, Artificial Sequence
  spacer sequence
guaccguuacuaccucauga

SEQ ID NO: 11573 - RNA, 20 nt, Artificial Sequence
  spacer sequence
ugaugagagacagaaguucc

SEQ ID NO: 11574 - RNA, 20 nt, Artificial Sequence
  spacer sequence
ugagguaguaacgguacaga

SEQ ID NO: 11575 - RNA, 20 nt, Artificial Sequence
  spacer sequence
ucaugagguaguaacgguac

SEQ ID NO: 11576 - RNA, 20 nt, Artificial Sequence
  spacer sequence
caucaugagguaguaacggu

SEQ ID NO: 11577 - RNA, 20 nt, Artificial Sequence
  spacer sequence
cucaucaugagguaguaacg

SEQ ID NO: 11578 - RNA, 20 nt, Artificial Sequence
  spacer sequence
gucucucaucaugagguagu

SEQ ID NO: 11579 - RNA, 20 nt, Artificial Sequence
  spacer sequence
auacuuagagccuuuuugug

SEQ ID NO: 11580 - RNA, 20 nt, Artificial Sequence
  spacer sequence
aaguauggaacuucugucuc

SEQ ID NO: 11581 - RNA, 20 nt, Artificial Sequence
  spacer sequence
aagaauucuuugccuguccu

SEQ ID NO: 11582 - RNA, 20 nt, Artificial Sequence
  spacer sequence
uagaacacaaaaaggcucua

SEQ ID NO: 11583 - RNA, 20 nt, Artificial Sequence
  spacer sequence
uugccuguccuaagaucaug

SEQ ID NO: 11584 - RNA, 20 nt, Artificial Sequence
  spacer sequence
uaagaucaugaggauauccu

SEQ ID NO: 11585 - RNA, 20 nt, Artificial Sequence
  spacer sequence
uaggacaggcaaagaauucu

SEQ ID NO: 11586 - RNA, 20 nt, Artificial Sequence
  spacer sequence
ugaggauauccucuguguuu

SEQ ID NO: 11587 - RNA, 20 nt, Artificial Sequence
  spacer sequence
ugaucuuaggacaggcaaag

SEQ ID NO: 11588 - RNA, 20 nt, Artificial Sequence
  spacer sequence
ucaugaucuuaggacaggca

SEQ ID NO: 11589 - RNA, 20 nt, Artificial Sequence
  spacer sequence
ucuguguuucuuuuaaaagc

SEQ ID NO: 11590 - RNA, 20 nt, Artificial Sequence
  spacer sequence
guguuucuuuuaaaagcuuu

SEQ ID NO: 11591 - RNA, 20 nt, Artificial Sequence
  spacer sequence
uuuaaaagcuuuacaguuuu

SEQ ID NO: 11592 - RNA, 20 nt, Artificial Sequence
  spacer sequence
gugcacuaaaacuguaaagc

SEQ ID NO: 11593 - RNA, 20 nt, Artificial Sequence
  spacer sequence
auggccuaucucaaguaaau

SEQ ID NO: 11594 - RNA, 20 nt, Artificial Sequence
  spacer sequence
caaguaaauuuuuuuguaug

SEQ ID NO: 11595 - RNA, 20 nt, Artificial Sequence
  spacer sequence
aguaaauuuuuuuguaugug

SEQ ID NO: 11596 - RNA, 20 nt, Artificial Sequence
  spacer sequence
cgcacauacaaaaaaauuua

SEQ ID NO: 11597 - RNA, 20 nt, Artificial Sequence
  spacer sequence
cacgcacauacaaaaaaauu

SEQ ID NO: 11598 - RNA, 20 nt, Artificial Sequence
  spacer sequence
ugucucacgcacauacaaaa

SEQ ID NO: 11599 - RNA, 20 nt, Artificial Sequence
  spacer sequence
uuuuuuaaaaaguuauuuca

SEQ ID NO: 11600 - RNA, 20 nt, Artificial Sequence
  spacer sequence
ucauccuuuauugaaaagcu

SEQ ID NO: 11601 - RNA, 20 nt, Artificial Sequence
  spacer sequence
uccuuuauugaaaagcuuuc

SEQ ID NO: 11602 - RNA, 20 nt, Artificial Sequence
  spacer sequence
uuuauugaaaagcuuucuuc

SEQ ID NO: 11603 - RNA, 20 nt, Artificial Sequence
  spacer sequence
auaaaggaugaugaaauaac

SEQ ID NO: 11604 - RNA, 20 nt, Artificial Sequence
  spacer sequence
ucccuccauugaacugcauu

SEQ ID NO: 11605 - RNA, 20 nt, Artificial Sequence
  spacer sequence
cuccauugaacugcauugga

SEQ ID NO: 11606 - RNA, 20 nt, Artificial Sequence
  spacer sequence
auugaacugcauuggaacuu

SEQ ID NO: 11607 - RNA, 20 nt, Artificial Sequence
  spacer sequence
auggagggaagaaagcuuuu

SEQ ID NO: 11608 - RNA, 20 nt, Artificial Sequence
  spacer sequence
aaugcaguucaauggaggga

SEQ ID NO: 11609 - RNA, 20 nt, Artificial Sequence
  spacer sequence
gucuaaaauuaaguggcuac

SEQ ID NO: 11610 - RNA, 20 nt, Artificial Sequence
  spacer sequence
aaaauuaaguggcuacauau

SEQ ID NO: 11611 - RNA, 20 nt, Artificial Sequence
  spacer sequence
gaccucauuauucuguuccu

SEQ ID NO: 11612 - RNA, 20 nt, Artificial Sequence
  spacer sequence
gaaauaggcccacacauaug

SEQ ID NO: 11613 - RNA, 20 nt, Artificial Sequence
  spacer sequence
uuauucuguuccuuucauca

SEQ ID NO: 11614 - RNA, 20 nt, Artificial Sequence
  spacer sequence
guuccuuucaucaccaguac

SEQ ID NO: 11615 - RNA, 20 nt, Artificial Sequence
  spacer sequence
uuucaucaccaguaccacac

SEQ ID NO: 11616 - RNA, 20 nt, Artificial Sequence
  spacer sequence
ucaccaguaccacacugucu

SEQ ID NO: 11617 - RNA, 20 nt, Artificial Sequence
  spacer sequence
ccaguaccacacugucuuga

SEQ ID NO: 11618 - RNA, 20 nt, Artificial Sequence
  spacer sequence
ugauugcuguaacuuuauag

SEQ ID NO: 11619 - RNA, 20 nt, Artificial Sequence
  spacer sequence
agacagugugguacugguga

SEQ ID NO: 11620 - RNA, 20 nt, Artificial Sequence
  spacer sequence
aaacuuacuauaaaguuaca

SEQ ID NO: 11621 - RNA, 20 nt, Artificial Sequence
  spacer sequence
uaauuucaaaacuuacuaua

SEQ ID NO: 11622 - RNA, 20 nt, Artificial Sequence
  spacer sequence
uccaacuuugcucuucuuug

SEQ ID NO: 11623 - RNA, 20 nt, Artificial Sequence
  spacer sequence
aacuuugcucuucuuugagg

SEQ ID NO: 11624 - RNA, 20 nt, Artificial Sequence
  spacer sequence
ucuuugagguuaucuuguca

SEQ ID NO: 11625 - RNA, 20 nt, Artificial Sequence
  spacer sequence
uugagguuaucuugucacaa

SEQ ID NO: 11626 - RNA, 20 nt, Artificial Sequence
  spacer sequence
aagaagagcaaaguuggaag

SEQ ID NO: 11627 - RNA, 20 nt, Artificial Sequence
  spacer sequence
ugucacaaggacccaagugg

SEQ ID NO: 11628 - RNA, 20 nt, Artificial Sequence
  spacer sequence
caaggacccaaguggcagua

SEQ ID NO: 11629 - RNA, 20 nt, Artificial Sequence
  spacer sequence
uugugacaagauaaccucaa

SEQ ID NO: 11630 - RNA, 20 nt, Artificial Sequence
  spacer sequence
ucaggugauuccaaugugaa

SEQ ID NO: 11631 - RNA, 20 nt, Artificial Sequence
  spacer sequence
ggugauuccaaugugaagcc

SEQ ID NO: 11632 - RNA, 20 nt, Artificial Sequence
  spacer sequence
ccugaggagcuuuaaaaauu

SEQ ID NO: 11633 - RNA, 20 nt, Artificial Sequence
  spacer sequence
aaugugaagccaagguuaag

SEQ ID NO: 11634 - RNA, 20 nt, Artificial Sequence
  spacer sequence
cauuggaaucaccugaggag

SEQ ID NO: 11635 - RNA, 20 nt, Artificial Sequence
  spacer sequence
uaaccuuggcuucacauugg

SEQ ID NO: 11636 - RNA, 20 nt, Artificial Sequence
  spacer sequence
uaggggcugaggaguccuag

SEQ ID NO: 11637 - RNA, 20 nt, Artificial Sequence
  spacer sequence
gccccuaagacgguacuucu

SEQ ID NO: 11638 - RNA, 20 nt, Artificial Sequence
  spacer sequence
ucagccccuaagacgguacu

SEQ ID NO: 11639 - RNA, 20 nt, Artificial Sequence
  spacer sequence
uaggcuggucccgcuggguu

SEQ ID NO: 11640 - RNA, 20 nt, Artificial Sequence
  spacer sequence
cgcuggguuugugguuuugu

SEQ ID NO: 11641 - RNA, 20 nt, Artificial Sequence
  spacer sequence
acgcauuuccuucaggacag

SEQ ID NO: 11642 - RNA, 20 nt, Artificial Sequence
  spacer sequence
uucaggacaguauguuuaua

SEQ ID NO: 11643 - RNA, 20 nt, Artificial Sequence
  spacer sequence
ggacaguauguuuauagucu

SEQ ID NO: 11644 - RNA, 20 nt, Artificial Sequence
  spacer sequence
ugaaggaaaugcguugaaaa

SEQ ID NO: 11645 - RNA, 20 nt, Artificial Sequence
  spacer sequence
guuugcuucugaauaauuuc

SEQ ID NO: 11646 - RNA, 20 nt, Artificial Sequence
  spacer sequence
gaauaauuucauguguaagu

SEQ ID NO: 11647 - RNA, 20 nt, Artificial Sequence
  spacer sequence
gaagcaaacagacuauaaac

SEQ ID NO: 11648 - RNA, 20 nt, Artificial Sequence
  spacer sequence
uguguaaguaaccacaucca

SEQ ID NO: 11649 - RNA, 20 nt, Artificial Sequence
  spacer sequence
aagggcuuuguggagaaaug

SEQ ID NO: 11650 - RNA, 20 nt, Artificial Sequence
  spacer sequence
acaaagcccuuggauguggu

SEQ ID NO: 11651 - RNA, 20 nt, Artificial Sequence
  spacer sequence
ccacaaagcccuuggaugug

SEQ ID NO: 11652 - RNA, 20 nt, Artificial Sequence
  spacer sequence
uaggcuuaaaggccauuucu

SEQ ID NO: 11653 - RNA, 20 nt, Artificial Sequence
  spacer sequence
uggcuccaagcugcugauca

SEQ ID NO: 11654 - RNA, 20 nt, Artificial Sequence
  spacer sequence
aagcugcugaucauugugcc

SEQ ID NO: 11655 - RNA, 20 nt, Artificial Sequence
  spacer sequence
gcagcuuggagccaagaguu

SEQ ID NO: 11656 - RNA, 20 nt, Artificial Sequence
  spacer sequence
uugugcccugucccgucccc

SEQ ID NO: 11657 - RNA, 20 nt, Artificial Sequence
  spacer sequence
cguccccucucccauagguu

SEQ ID NO: 11658 - RNA, 20 nt, Artificial Sequence
  spacer sequence
ccucucccauagguucagug

SEQ ID NO: 11659 - RNA, 20 nt, Artificial Sequence
  spacer sequence
cccauagguucaguggcuau

SEQ ID NO: 11660 - RNA, 20 nt, Artificial Sequence
  spacer sequence
cauagguucaguggcuauug

SEQ ID NO: 11661 - RNA, 20 nt, Artificial Sequence
  spacer sequence
guggcuauugcaugagauaa

SEQ ID NO: 11662 - RNA, 20 nt, Artificial Sequence
  spacer sequence
ugcaauagccacugaaccua

SEQ ID NO: 11663 - RNA, 20 nt, Artificial Sequence
  spacer sequence
caugcaauagccacugaacc

SEQ ID NO: 11664 - RNA, 20 nt, Artificial Sequence
  spacer sequence
aauuaucucaugcaauagcc

SEQ ID NO: 11665 - RNA, 20 nt, Artificial Sequence
  spacer sequence
aucaaauuaucucaugcaau

SEQ ID NO: 11666 - RNA, 20 nt, Artificial Sequence
  spacer sequence
uuucuaucaaauuaucucau

SEQ ID NO: 11667 - RNA, 20 nt, Artificial Sequence
  spacer sequence
ccauguaacucuuuucuauc

SEQ ID NO: 11668 - RNA, 20 nt, Artificial Sequence
  spacer sequence
ccucuuuggugucuaagugc

SEQ ID NO: 11669 - RNA, 20 nt, Artificial Sequence
  spacer sequence
uuggugucuaagugcccaaa

SEQ ID NO: 11670 - RNA, 20 nt, Artificial Sequence
  spacer sequence
aagugcccaaacuccccugc

SEQ ID NO: 11671 - RNA, 20 nt, Artificial Sequence
  spacer sequence
ccugcuuagacagucacuuu

SEQ ID NO: 11672 - RNA, 20 nt, Artificial Sequence
  spacer sequence
aagcaggggaguuugggcac

SEQ ID NO: 11673 - RNA, 20 nt, Artificial Sequence
  spacer sequence
cuuuccugcguccccuugua

SEQ ID NO: 11674 - RNA, 20 nt, Artificial Sequence
  spacer sequence
ugcguccccuuguauuagcu

SEQ ID NO: 11675 - RNA, 20 nt, Artificial Sequence
  spacer sequence
ccuuguauuagcuucaacug

SEQ ID NO: 11676 - RNA, 20 nt, Artificial Sequence
  spacer sequence
acugaaguagaggaaaaauu

SEQ ID NO: 11677 - RNA, 20 nt, Artificial Sequence
  spacer sequence
guugaagcuaauacaagggg

SEQ ID NO: 11678 - RNA, 20 nt, Artificial Sequence
  spacer sequence
acuucaguugaagcuaauac

SEQ ID NO: 11679 - RNA, 20 nt, Artificial Sequence
  spacer sequence
ucuacuucaguugaagcuaa

SEQ ID NO: 11680 - RNA, 20 nt, Artificial Sequence
  spacer sequence
cauaauuuuaagccuggcag

SEQ ID NO: 11681 - RNA, 20 nt, Artificial Sequence
  spacer sequence
cuguuaaauuggauuggaga

SEQ ID NO: 11682 - RNA, 20 nt, Artificial Sequence
  spacer sequence
guuaaauuggauuggagaag

SEQ ID NO: 11683 - RNA, 20 nt, Artificial Sequence
  spacer sequence
aauuuaacagagagucccau

SEQ ID NO: 11684 - RNA, 20 nt, Artificial Sequence
  spacer sequence
aauccaauuuaacagagagu

SEQ ID NO: 11685 - RNA, 20 nt, Artificial Sequence
  spacer sequence
ccaauccaauuuaacagaga

SEQ ID NO: 11686 - RNA, 20 nt, Artificial Sequence
  spacer sequence
ucuccaauccaauuuaacag

SEQ ID NO: 11687 - RNA, 20 nt, Artificial Sequence
  spacer sequence
cauuuaguaaaacugauuuu

SEQ ID NO: 11688 - RNA, 20 nt, Artificial Sequence
  spacer sequence
guuuuacuaaaugugaaguu

SEQ ID NO: 11689 - RNA, 20 nt, Artificial Sequence
  spacer sequence
ccccacucaccucucaaacc

SEQ ID NO: 11690 - RNA, 20 nt, Artificial Sequence
  spacer sequence
ccucucaaaccaggugucuc

SEQ ID NO: 11691 - RNA, 20 nt, Artificial Sequence
  spacer sequence
caaaccaggugucucuaagu

SEQ ID NO: 11692 - RNA, 20 nt, Artificial Sequence
  spacer sequence
aaccaggugucucuaaguua

SEQ ID NO: 11693 - RNA, 20 nt, Artificial Sequence
  spacer sequence
cuaaguuaagaucuccucuu

SEQ ID NO: 11694 - RNA, 20 nt, Artificial Sequence
  spacer sequence
aaguuaagaucuccucuugg

SEQ ID NO: 11695 - RNA, 20 nt, Artificial Sequence
  spacer sequence
uaacuuagagacaccugguu

SEQ ID NO: 11696 - RNA, 20 nt, Artificial Sequence
  spacer sequence
ccucuuggccgggugcggug

SEQ ID NO: 11697 - RNA, 20 nt, Artificial Sequence
  spacer sequence
ucuuggccgggugcgguggc

SEQ ID NO: 11698 - RNA, 20 nt, Artificial Sequence
  spacer sequence
uggccgggugcgguggcuca

SEQ ID NO: 11699 - RNA, 20 nt, Artificial Sequence
  spacer sequence
caccuauaaucccagcgcuu

SEQ ID NO: 11700 - RNA, 20 nt, Artificial Sequence
  spacer sequence
cagcgcuuugggaggccgag

SEQ ID NO: 11701 - RNA, 20 nt, Artificial Sequence
  spacer sequence
caaagcgcugggauuauagg

SEQ ID NO: 11702 - RNA, 20 nt, Artificial Sequence
  spacer sequence
gccucccaaagcgcugggau

SEQ ID NO: 11703 - RNA, 20 nt, Artificial Sequence
  spacer sequence
acccgccucggccucccaaa

SEQ ID NO: 11704 - RNA, 20 nt, Artificial Sequence
  spacer sequence
caacgucaggagaucgagac

SEQ ID NO: 11705 - RNA, 20 nt, Artificial Sequence
  spacer sequence
ggagaucgagaccaugcugg

SEQ ID NO: 11706 - RNA, 20 nt, Artificial Sequence
  spacer sequence
ugacguugugauccacccgc

SEQ ID NO: 11707 - RNA, 20 nt, Artificial Sequence
  spacer sequence
ccugacguugugauccaccc

SEQ ID NO: 11708 - RNA, 20 nt, Artificial Sequence
  spacer sequence
agaccaugcuggcuaacaug

SEQ ID NO: 11709 - RNA, 20 nt, Artificial Sequence
  spacer sequence
aucuccugacguugugaucc

SEQ ID NO: 11710 - RNA, 20 nt, Artificial Sequence
  spacer sequence
cgaucuccugacguugugau

SEQ ID NO: 11711 - RNA, 20 nt, Artificial Sequence
  spacer sequence
ccauguuagccagcaugguc

SEQ ID NO: 11712 - RNA, 20 nt, Artificial Sequence
  spacer sequence
cuacuaaaaauacaaaaaau

SEQ ID NO: 11713 - RNA, 20 nt, Artificial Sequence
  spacer sequence
acuaaaaauacaaaaaauua

SEQ ID NO: 11714 - RNA, 20 nt, Artificial Sequence
  spacer sequence
cagcuacucgggaggcugag

SEQ ID NO: 11715 - RNA, 20 nt, Artificial Sequence
  spacer sequence
ggaggcugaggcaggagaau

SEQ ID NO: 11716 - RNA, 20 nt, Artificial Sequence
  spacer sequence
cgaguagcugggacuacagg

SEQ ID NO: 11717 - RNA, 20 nt, Artificial Sequence
  spacer sequence
gccucccgaguagcugggac

SEQ ID NO: 11718 - RNA, 20 nt, Artificial Sequence
  spacer sequence
ugccucagccucccgaguag

SEQ ID NO: 11719 - RNA, 20 nt, Artificial Sequence
  spacer sequence
ccugccucagccucccgagu

SEQ ID NO: 11720 - RNA, 20 nt, Artificial Sequence
  spacer sequence
ugccauucuccugccucagc

SEQ ID NO: 11721 - RNA, 20 nt, Artificial Sequence
  spacer sequence
cggguucaugccauucuccu

SEQ ID NO: 11722 - RNA, 20 nt, Artificial Sequence
  spacer sequence
gccucccggguucaugccau

SEQ ID NO: 11723 - RNA, 20 nt, Artificial Sequence
  spacer sequence
cugcaagcuccgccucccgg

SEQ ID NO: 11724 - RNA, 20 nt, Artificial Sequence
  spacer sequence
gcucacugcaagcuccgccu

SEQ ID NO: 11725 - RNA, 20 nt, Artificial Sequence
  spacer sequence
cggcucacugcaagcuccgc

SEQ ID NO: 11726 - RNA, 20 nt, Artificial Sequence
  spacer sequence
cacuacugcacuuuagccug

SEQ ID NO: 11727 - RNA, 20 nt, Artificial Sequence
  spacer sequence
guugcccaggcuaaagugca

SEQ ID NO: 11728 - RNA, 20 nt, Artificial Sequence
  spacer sequence
gucucaaaaaaaaaaaaaaa

SEQ ID NO: 11729 - RNA, 20 nt, Artificial Sequence
  spacer sequence
caaaaaaaaaaaaaaauucu

SEQ ID NO: 11730 - RNA, 20 nt, Artificial Sequence
  spacer sequence
aaaaaaaaaaaaaauucucc

SEQ ID NO: 11731 - RNA, 20 nt, Artificial Sequence
  spacer sequence
ccucucuugguaaguuaggg

SEQ ID NO: 11732 - RNA, 20 nt, Artificial Sequence
  spacer sequence
ucucuugguaaguuagggua

SEQ ID NO: 11733 - RNA, 20 nt, Artificial Sequence
  spacer sequence
cuugguaaguuaggguauaa

SEQ ID NO: 11734 - RNA, 20 nt, Artificial Sequence
  spacer sequence
ugguaaguuaggguauaaga

SEQ ID NO: 11735 - RNA, 20 nt, Artificial Sequence
  spacer sequence
uauacccuaacuuaccaaga

SEQ ID NO: 11736 - RNA, 20 nt, Artificial Sequence
  spacer sequence
gcagcuuaucuuauacccua

SEQ ID NO: 11737 - RNA, 20 nt, Artificial Sequence
  spacer sequence
cuuuguuucagcagcuuauc

SEQ ID NO: 11738 - RNA, 20 nt, Artificial Sequence
  spacer sequence
cucucagguaaugcucaaga

SEQ ID NO: 11739 - RNA, 20 nt, Artificial Sequence
  spacer sequence
cucagguaaugcucaagaag

SEQ ID NO: 11740 - RNA, 20 nt, Artificial Sequence
  spacer sequence
cagguaaugcucaagaagug

SEQ ID NO: 11741 - RNA, 20 nt, Artificial Sequence
  spacer sequence
gguaaugcucaagaagugag

SEQ ID NO: 11742 - RNA, 20 nt, Artificial Sequence
  spacer sequence
agaagugagcaguccagagc

SEQ ID NO: 11743 - RNA, 20 nt, Artificial Sequence
  spacer sequence
ugagcauuaccugagagaga

SEQ ID NO: 11744 - RNA, 20 nt, Artificial Sequence
  spacer sequence
cuucuugagcauuaccugag

SEQ ID NO: 11745 - RNA, 20 nt, Artificial Sequence
  spacer sequence
agagcuggugaggugauucu

SEQ ID NO: 11746 - RNA, 20 nt, Artificial Sequence
  spacer sequence
ggacugcucacuucuugagc

SEQ ID NO: 11747 - RNA, 20 nt, Artificial Sequence
  spacer sequence
ccagcucuggacugcucacu

SEQ ID NO: 11748 - RNA, 20 nt, Artificial Sequence
  spacer sequence
ccucaccagcucuggacugc

SEQ ID NO: 11749 - RNA, 20 nt, Artificial Sequence
  spacer sequence
gccauccccaacaugugaac

SEQ ID NO: 11750 - RNA, 20 nt, Artificial Sequence
  spacer sequence
ccaacaugugaacuccaggg

SEQ ID NO: 11751 - RNA, 20 nt, Artificial Sequence
  spacer sequence
cauguuggggauggcagaau

SEQ ID NO: 11752 - RNA, 20 nt, Artificial Sequence
  spacer sequence
agggugacuuugccauuugu

SEQ ID NO: 11753 - RNA, 20 nt, Artificial Sequence
  spacer sequence
cccuggaguucacauguugg

SEQ ID NO: 11754 - RNA, 20 nt, Artificial Sequence
  spacer sequence
ugauuuucuagccacaggau

SEQ ID NO: 11755 - RNA, 20 nt, Artificial Sequence
  spacer sequence
ugacaaauggcaaagucacc

SEQ ID NO: 11756 - RNA, 20 nt, Artificial Sequence
  spacer sequence
agccacaggauggagaaaga

SEQ ID NO: 11757 - RNA, 20 nt, Artificial Sequence
  spacer sequence
uguggcuagaaaaucaugac

SEQ ID NO: 11758 - RNA, 20 nt, Artificial Sequence
  spacer sequence
auccuguggcuagaaaauca

SEQ ID NO: 11759 - RNA, 20 nt, Artificial Sequence
  spacer sequence
ccauccuguggcuagaaaau

SEQ ID NO: 11760 - RNA, 20 nt, Artificial Sequence
  spacer sequence
uucuccauccuguggcuaga

SEQ ID NO: 11761 - RNA, 20 nt, Artificial Sequence
  spacer sequence
ucuuucuccauccuguggcu

SEQ ID NO: 11762 - RNA, 20 nt, Artificial Sequence
  spacer sequence
acuuccucuuucuccauccu

SEQ ID NO: 11763 - RNA, 20 nt, Artificial Sequence
  spacer sequence
auuuuaggauguuacauacu

SEQ ID NO: 11764 - RNA, 20 nt, Artificial Sequence
  spacer sequence
uaaaauggaaacugcaggcc

SEQ ID NO: 11765 - RNA, 20 nt, Artificial Sequence
  spacer sequence
uguucacucauaucccauug

SEQ ID NO: 11766 - RNA, 20 nt, Artificial Sequence
  spacer sequence
cucauaucccauuggucaga

SEQ ID NO: 11767 - RNA, 20 nt, Artificial Sequence
  spacer sequence
uaucccauuggucagagcuu

SEQ ID NO: 11768 - RNA, 20 nt, Artificial Sequence
  spacer sequence
cauuggucagagcuugguca

SEQ ID NO: 11769 - RNA, 20 nt, Artificial Sequence
  spacer sequence
gagcuuggucacagggccau

SEQ ID NO: 11770 - RNA, 20 nt, Artificial Sequence
  spacer sequence
gaccaaugggauaugaguga

SEQ ID NO: 11771 - RNA, 20 nt, Artificial Sequence
  spacer sequence
cagggccaugcaaggugcag

SEQ ID NO: 11772 - RNA, 20 nt, Artificial Sequence
  spacer sequence
ccugcaccuugcauggcccu

SEQ ID NO: 11773 - RNA, 20 nt, Artificial Sequence
  spacer sequence
cagccuccccugcaccuugc

SEQ ID NO: 11774 - RNA, 20 nt, Artificial Sequence
  spacer sequence
aaaaauaccuuucccagccu

SEQ ID NO: 11775 - RNA, 20 nt, Artificial Sequence
  spacer sequence
gguccaaaaauaccuuuccc

SEQ ID NO: 11776 - RNA, 20 nt, Artificial Sequence
  spacer sequence
uccgguccaaaaauaccuuu

SEQ ID NO: 11777 - RNA, 20 nt, Artificial Sequence
  spacer sequence
ugcugaaucucagaaaacuu

SEQ ID NO: 11778 - RNA, 20 nt, Artificial Sequence
  spacer sequence
gcaagauacauggucauccg

SEQ ID NO: 11779 - RNA, 20 nt, Artificial Sequence
  spacer sequence
cagaaaacuucuauuauuaa

SEQ ID NO: 11780 - RNA, 20 nt, Artificial Sequence
  spacer sequence
gaaaacuucuauuauuaaag

SEQ ID NO: 11781 - RNA, 20 nt, Artificial Sequence
  spacer sequence
gagauucagcaagauacaug

SEQ ID NO: 11782 - RNA, 20 nt, Artificial Sequence
  spacer sequence
auuauuaaagguacuaaagu

SEQ ID NO: 11783 - RNA, 20 nt, Artificial Sequence
  spacer sequence
gaauggauaugggaggaaaa

SEQ ID NO: 11784 - RNA, 20 nt, Artificial Sequence
  spacer sequence
gacuuuaguaccuuuaauaa

SEQ ID NO: 11785 - RNA, 20 nt, Artificial Sequence
  spacer sequence
auucagacuuuaguaccuuu

SEQ ID NO: 11786 - RNA, 20 nt, Artificial Sequence
  spacer sequence
cauauccauucagacuuuag

SEQ ID NO: 11787 - RNA, 20 nt, Artificial Sequence
  spacer sequence
ucccauauccauucagacuu

SEQ ID NO: 11788 - RNA, 20 nt, Artificial Sequence
  spacer sequence
uuaaucuucaccauggcugu

SEQ ID NO: 11789 - RNA, 20 nt, Artificial Sequence
  spacer sequence
ucaccauggcugucuuuugc

SEQ ID NO: 11790 - RNA, 20 nt, Artificial Sequence
  spacer sequence
ccauggcugucuuuugccaa

SEQ ID NO: 11791 - RNA, 20 nt, Artificial Sequence
  spacer sequence
uuugccaagagcccaauaag

SEQ ID NO: 11792 - RNA, 20 nt, Artificial Sequence
  spacer sequence
uggcaaaagacagccauggu

SEQ ID NO: 11793 - RNA, 20 nt, Artificial Sequence
  spacer sequence
ccacccaaaucucaucuuga

SEQ ID NO: 11794 - RNA, 20 nt, Artificial Sequence
  spacer sequence
caucuugaauuguagcuccu

SEQ ID NO: 11795 - RNA, 20 nt, Artificial Sequence
  spacer sequence
ucuugaauuguagcuccuau

SEQ ID NO: 11796 - RNA, 20 nt, Artificial Sequence
  spacer sequence
ugaauuguagcuccuauaau

SEQ ID NO: 11797 - RNA, 20 nt, Artificial Sequence
  spacer sequence
agaugagauuugggugggga

SEQ ID NO: 11798 - RNA, 20 nt, Artificial Sequence
  spacer sequence
uauaauucccacguacugug

SEQ ID NO: 11799 - RNA, 20 nt, Artificial Sequence
  spacer sequence
cacguacuguggaagggacc

SEQ ID NO: 11800 - RNA, 20 nt, Artificial Sequence
  spacer sequence
acaguacgugggaauuauag

SEQ ID NO: 11801 - RNA, 20 nt, Artificial Sequence
  spacer sequence
cuuccacaguacgugggaau

SEQ ID NO: 11802 - RNA, 20 nt, Artificial Sequence
  spacer sequence
caccaggucccuuccacagu

SEQ ID NO: 11803 - RNA, 20 nt, Artificial Sequence
  spacer sequence
cccaccaggucccuuccaca

SEQ ID NO: 11804 - RNA, 20 nt, Artificial Sequence
  spacer sequence
aauuaucucccaccaggucc

SEQ ID NO: 11805 - RNA, 20 nt, Artificial Sequence
  spacer sequence
ugggggcaggucuuucccgu

SEQ ID NO: 11806 - RNA, 20 nt, Artificial Sequence
  spacer sequence
uucccgugcuauucuuguga

SEQ ID NO: 11807 - RNA, 20 nt, Artificial Sequence
  spacer sequence
cgugcuauucuugugauagu

SEQ ID NO: 11808 - RNA, 20 nt, Artificial Sequence
  spacer sequence
ugugauagugaauaagucuc

SEQ ID NO: 11809 - RNA, 20 nt, Artificial Sequence
  spacer sequence
caagaauagcacgggaaaga

SEQ ID NO: 11810 - RNA, 20 nt, Artificial Sequence
  spacer sequence
cuaucacaagaauagcacgg

SEQ ID NO: 11811 - RNA, 20 nt, Artificial Sequence
  spacer sequence
cacaagauuugauaguuuug

SEQ ID NO: 11812 - RNA, 20 nt, Artificial Sequence
  spacer sequence
caagauuugauaguuuugua

SEQ ID NO: 11813 - RNA, 20 nt, Artificial Sequence
  spacer sequence
ugugagacuuauucacuauc

SEQ ID NO: 11814 - RNA, 20 nt, Artificial Sequence
  spacer sequence
aaucuugugagacuuauuca

SEQ ID NO: 11815 - RNA, 20 nt, Artificial Sequence
  spacer sequence
ccuuuacaaaacuaucaaau

SEQ ID NO: 11816 - RNA, 20 nt, Artificial Sequence
  spacer sequence
uuugccaucaccaaauuacu

SEQ ID NO: 11817 - RNA, 20 nt, Artificial Sequence
  spacer sequence
ccaaauuacugaccuggaau

SEQ ID NO: 11818 - RNA, 20 nt, Artificial Sequence
  spacer sequence
guaauuuggugauggcaaaa

SEQ ID NO: 11819 - RNA, 20 nt, Artificial Sequence
  spacer sequence
aggucaguaauuuggugaug

SEQ ID NO: 11820 - RNA, 20 nt, Artificial Sequence
  spacer sequence
uacugccuucuauccuaccu

SEQ ID NO: 11821 - RNA, 20 nt, Artificial Sequence
  spacer sequence
auccuaccucuucugcucag

SEQ ID NO: 11822 - RNA, 20 nt, Artificial Sequence
  spacer sequence
uaccucuucugcucagccaa

SEQ ID NO: 11823 - RNA, 20 nt, Artificial Sequence
  spacer sequence
ucugcucagccaauuaauau

SEQ ID NO: 11824 - RNA, 20 nt, Artificial Sequence
  spacer sequence
gcucagccaauuaauauuuu

SEQ ID NO: 11825 - RNA, 20 nt, Artificial Sequence
  spacer sequence
gccaauuaauauuuuagagu

SEQ ID NO: 11826 - RNA, 20 nt, Artificial Sequence
  spacer sequence
cgccuguaaucccagcacuu

SEQ ID NO: 11827 - RNA, 20 nt, Artificial Sequence
  spacer sequence
uaucuauuucaaagugugaa

SEQ ID NO: 11828 - RNA, 20 nt, Artificial Sequence
  spacer sequence
auuucaaagugugaaucagg

SEQ ID NO: 11829 - RNA, 20 nt, Artificial Sequence
  spacer sequence
aagugugaaucaggagagag

SEQ ID NO: 11830 - RNA, 20 nt, Artificial Sequence
  spacer sequence
cacuuugaaauagauacgau

SEQ ID NO: 11831 - RNA, 20 nt, Artificial Sequence
  spacer sequence
ggagagagggugguaucugc

SEQ ID NO: 11832 - RNA, 20 nt, Artificial Sequence
  spacer sequence
ugauucacacuuugaaauag

SEQ ID NO: 11833 - RNA, 20 nt, Artificial Sequence
  spacer sequence
ccugauucacacuuugaaau

SEQ ID NO: 11834 - RNA, 20 nt, Artificial Sequence
  spacer sequence
cuccugauucacacuuugaa

SEQ ID NO: 11835 - RNA, 20 nt, Artificial Sequence
  spacer sequence
gcugcgucugcuccuuacuu

SEQ ID NO: 11836 - RNA, 20 nt, Artificial Sequence
  spacer sequence
gcuccuuacuuacguaaaga

SEQ ID NO: 11837 - RNA, 20 nt, Artificial Sequence
  spacer sequence
uuacuuacguaaagaaagga

SEQ ID NO: 11838 - RNA, 20 nt, Artificial Sequence
  spacer sequence
uuacguaaguaaggagcaga

SEQ ID NO: 11839 - RNA, 20 nt, Artificial Sequence
  spacer sequence
uuucuuuacguaaguaagga

SEQ ID NO: 11840 - RNA, 20 nt, Artificial Sequence
  spacer sequence
aaaggaaaguugcucauauu

SEQ ID NO: 11841 - RNA, 20 nt, Artificial Sequence
  spacer sequence
cuuguucuaaaggaaaguug

SEQ ID NO: 11842 - RNA, 20 nt, Artificial Sequence
  spacer sequence
uugccuucuaucugaacaag

SEQ ID NO: 11843 - RNA, 20 nt, Artificial Sequence
  spacer sequence
aucugaacaaguaaguucua

SEQ ID NO: 11844 - RNA, 20 nt, Artificial Sequence
  spacer sequence
gaacaaguaaguucuauuag

SEQ ID NO: 11845 - RNA, 20 nt, Artificial Sequence
  spacer sequence
gauagaaggcaaagaucccu

SEQ ID NO: 11846 - RNA, 20 nt, Artificial Sequence
  spacer sequence
auuagcaagggagaacaggg

SEQ ID NO: 11847 - RNA, 20 nt, Artificial Sequence
  spacer sequence
cuugcuaauagaacuuacuu

SEQ ID NO: 11848 - RNA, 20 nt, Artificial Sequence
  spacer sequence
cccuugcuaauagaacuuac

SEQ ID NO: 11849 - RNA, 20 nt, Artificial Sequence
  spacer sequence
cuguucucccuugcuaauag

SEQ ID NO: 11850 - RNA, 20 nt, Artificial Sequence
  spacer sequence
ucccuguucucccuugcuaa

SEQ ID NO: 11851 - RNA, 20 nt, Artificial Sequence
  spacer sequence
uucuucccuguucucccuug

SEQ ID NO: 11852 - RNA, 20 nt, Artificial Sequence
  spacer sequence
agauguuagaauugcacuag

SEQ ID NO: 11853 - RNA, 20 nt, Artificial Sequence
  spacer sequence
ucuucuuuuuguuuuaaagu

SEQ ID NO: 11854 - RNA, 20 nt, Artificial Sequence
  spacer sequence
ucuuuuuguuuuaaaguccc

SEQ ID NO: 11855 - RNA, 20 nt, Artificial Sequence
  spacer sequence
uuuuguuuuaaagucccagc

SEQ ID NO: 11856 - RNA, 20 nt, Artificial Sequence
  spacer sequence
cagcauaugaaaaguagaaa

SEQ ID NO: 11857 - RNA, 20 nt, Artificial Sequence
  spacer sequence
uaugcugggacuuuaaaaca

SEQ ID NO: 11858 - RNA, 20 nt, Artificial Sequence
  spacer sequence
acuuuucauaugcugggacu

SEQ ID NO: 11859 - RNA, 20 nt, Artificial Sequence
  spacer sequence
uuaacuauuuuucuacuuuu

SEQ ID NO: 11860 - RNA, 20 nt, Artificial Sequence
  spacer sequence
aguagccuccuuaacuauuu

SEQ ID NO: 11861 - RNA, 20 nt, Artificial Sequence
  spacer sequence
cuaguagccuccuuaacuau

SEQ ID NO: 11862 - RNA, 20 nt, Artificial Sequence
  spacer sequence
gcuguuaccucuaguugcug

SEQ ID NO: 11863 - RNA, 20 nt, Artificial Sequence
  spacer sequence
acaugucagcuguuaccucu

SEQ ID NO: 11864 - RNA, 20 nt, Artificial Sequence
  spacer sequence
cugucaacaugucagcuguu

SEQ ID NO: 11865 - RNA, 20 nt, Artificial Sequence
  spacer sequence
ucacugucaacaugucagcu

SEQ ID NO: 11866 - RNA, 20 nt, Artificial Sequence
  spacer sequence
ucuucacugucaacauguca

SEQ ID NO: 11867 - RNA, 20 nt, Artificial Sequence
  spacer sequence
auaggaagcagacacaagaa

SEQ ID NO: 11868 - RNA, 20 nt, Artificial Sequence
  spacer sequence
uauagauggcugucuucuuc

SEQ ID NO: 11869 - RNA, 20 nt, Artificial Sequence
  spacer sequence
gcuuccuauagauggcuguc

SEQ ID NO: 11870 - RNA, 20 nt, Artificial Sequence
  spacer sequence
ugugucugcuuccuauagau

SEQ ID NO: 11871 - RNA, 20 nt, Artificial Sequence
  spacer sequence
uuguguguucuugugucugc

SEQ ID NO: 11872 - RNA, 20 nt, Artificial Sequence
  spacer sequence
uguguauguucuuugugugu

SEQ ID NO: 11873 - RNA, 20 nt, Artificial Sequence
  spacer sequence
uguguguucuuguguauguu

SEQ ID NO: 11874 - RNA, 20 nt, Artificial Sequence
  spacer sequence
auagacagcaaucuauagga

SEQ ID NO: 11875 - RNA, 20 nt, Artificial Sequence
  spacer sequence
auagaucguguguguucuug

SEQ ID NO: 11876 - RNA, 20 nt, Artificial Sequence
  spacer sequence
auaggaagcagacgaaagaa

SEQ ID NO: 11877 - RNA, 20 nt, Artificial Sequence
  spacer sequence
uauagauugcugucuauaga

SEQ ID NO: 11878 - RNA, 20 nt, Artificial Sequence
  spacer sequence
auaacccccgguggcacugg

SEQ ID NO: 11879 - RNA, 20 nt, Artificial Sequence
  spacer sequence
caacaaggcugcuauacaca

SEQ ID NO: 11880 - RNA, 20 nt, Artificial Sequence
  spacer sequence
ggccccagugaaugaggaau

SEQ ID NO: 11881 - RNA, 20 nt, Artificial Sequence
  spacer sequence
cuggggccugauguguauag

SEQ ID NO: 11882 - RNA, 20 nt, Artificial Sequence
  spacer sequence
guucuaucacacaccgccuu

SEQ ID NO: 11883 - RNA, 20 nt, Artificial Sequence
  spacer sequence
ucuguucuaucacacaccgc

SEQ ID NO: 11884 - RNA, 20 nt, Artificial Sequence
  spacer sequence
uccuugugacuuucaaggca

SEQ ID NO: 11885 - RNA, 20 nt, Artificial Sequence
  spacer sequence
uugugacuuucaaggcacaa

SEQ ID NO: 11886 - RNA, 20 nt, Artificial Sequence
  spacer sequence
caaggaugaacugggcauag

SEQ ID NO: 11887 - RNA, 20 nt, Artificial Sequence
  spacer sequence
aggcacaacuuucagcucuc

SEQ ID NO: 11888 - RNA, 20 nt, Artificial Sequence
  spacer sequence
gcucucagcuggaugccaca

SEQ ID NO: 11889 - RNA, 20 nt, Artificial Sequence
  spacer sequence
cagcuggaugccacaucugg

SEQ ID NO: 11890 - RNA, 20 nt, Artificial Sequence
  spacer sequence
gcuggaugccacaucuggac

SEQ ID NO: 11891 - RNA, 20 nt, Artificial Sequence
  spacer sequence
agcugagagcugaaaguugu

SEQ ID NO: 11892 - RNA, 20 nt, Artificial Sequence
  spacer sequence
cucacuguuuggcuggaaga

SEQ ID NO: 11893 - RNA, 20 nt, Artificial Sequence
  spacer sequence
cccucacuguuuggcuggaa

SEQ ID NO: 11894 - RNA, 20 nt, Artificial Sequence
  spacer sequence
uguuugggauucugacauuc

SEQ ID NO: 11895 - RNA, 20 nt, Artificial Sequence
  spacer sequence
caaacaugacaguguuaaau

SEQ ID NO: 11896 - RNA, 20 nt, Artificial Sequence
  spacer sequence
gacauucuucucuuuuuuga

SEQ ID NO: 11897 - RNA, 20 nt, Artificial Sequence
  spacer sequence
gaaucccaaacaugacagug

SEQ ID NO: 11898 - RNA, 20 nt, Artificial Sequence
  spacer sequence
ucucuuuuuugagagagaga

SEQ ID NO: 11899 - RNA, 20 nt, Artificial Sequence
  spacer sequence
cuuuuuugagagagagagac

SEQ ID NO: 11900 - RNA, 20 nt, Artificial Sequence
  spacer sequence
uuuuugagagagagagacag

SEQ ID NO: 11901 - RNA, 20 nt, Artificial Sequence
  spacer sequence
aaaaagagaagaaugucaga

SEQ ID NO: 11902 - RNA, 20 nt, Artificial Sequence
  spacer sequence
caaaaaagagaagaauguca

SEQ ID NO: 11903 - RNA, 20 nt, Artificial Sequence
  spacer sequence
cucaaaaaagagaagaaugu

SEQ ID NO: 11904 - RNA, 20 nt, Artificial Sequence
  spacer sequence
cucucaaaaaagagaagaau

SEQ ID NO: 11905 - RNA, 20 nt, Artificial Sequence
  spacer sequence
cucucucaaaaaagagaaga

SEQ ID NO: 11906 - RNA, 20 nt, Artificial Sequence
  spacer sequence
cucucucucaaaaaagagaa

SEQ ID NO: 11907 - RNA, 20 nt, Artificial Sequence
  spacer sequence
uacucuguugcccaggcugu

SEQ ID NO: 11908 - RNA, 20 nt, Artificial Sequence
  spacer sequence
guugcccaggcuguagugca

SEQ ID NO: 11909 - RNA, 20 nt, Artificial Sequence
  spacer sequence
cggcacuuugggaggcugag

SEQ ID NO: 11910 - RNA, 20 nt, Artificial Sequence
  spacer sequence
ugccuguaaucccggcacuu

SEQ ID NO: 11911 - RNA, 20 nt, Artificial Sequence
  spacer sequence
uuuuuuguagagacaggguc

SEQ ID NO: 11912 - RNA, 20 nt, Artificial Sequence
  spacer sequence
acaaaaaaagaaaaaauugg

SEQ ID NO: 11913 - RNA, 20 nt, Artificial Sequence
  spacer sequence
cuacaaaaaaagaaaaaauu

SEQ ID NO: 11914 - RNA, 20 nt, Artificial Sequence
  spacer sequence
uucuguguuguccaggcuug

SEQ ID NO: 11915 - RNA, 20 nt, Artificial Sequence
  spacer sequence
guguuguccaggcuuggucu

SEQ ID NO: 11916 - RNA, 20 nt, Artificial Sequence
  spacer sequence
aggcuuggucucaaacuccu

SEQ ID NO: 11917 - RNA, 20 nt, Artificial Sequence
  spacer sequence
caaacuccuggccucaagag

SEQ ID NO: 11918 - RNA, 20 nt, Artificial Sequence
  spacer sequence
aacuccuggccucaagagau

SEQ ID NO: 11919 - RNA, 20 nt, Artificial Sequence
  spacer sequence
uggccucaagagauccucca

SEQ ID NO: 11920 - RNA, 20 nt, Artificial Sequence
  spacer sequence
agagauccuccagccucagu

SEQ ID NO: 11921 - RNA, 20 nt, Artificial Sequence
  spacer sequence
ugaggccaggaguuugagac

SEQ ID NO: 11922 - RNA, 20 nt, Artificial Sequence
  spacer sequence
cuugaggccaggaguuugag

SEQ ID NO: 11923 - RNA, 20 nt, Artificial Sequence
  spacer sequence
uccagccucagucuccugaa

SEQ ID NO: 11924 - RNA, 20 nt, Artificial Sequence
  spacer sequence
agccucagucuccugaagug

SEQ ID NO: 11925 - RNA, 20 nt, Artificial Sequence
  spacer sequence
caaacaguuucaauuuagua

SEQ ID NO: 11926 - RNA, 20 nt, Artificial Sequence
  spacer sequence
uauuaggucacaaacaguuu

SEQ ID NO: 11927 - RNA, 20 nt, Artificial Sequence
  spacer sequence
ucuguuccaaggaaugagug

SEQ ID NO: 11928 - RNA, 20 nt, Artificial Sequence
  spacer sequence
guuccaaggaaugaguggaa

SEQ ID NO: 11929 - RNA, 20 nt, Artificial Sequence
  spacer sequence
aaggaaugaguggaaaaggu

SEQ ID NO: 11930 - RNA, 20 nt, Artificial Sequence
  spacer sequence
uuggaacagaugagucauau

SEQ ID NO: 11931 - RNA, 20 nt, Artificial Sequence
  spacer sequence
uuccuuggaacagaugaguc

SEQ ID NO: 11932 - RNA, 20 nt, Artificial Sequence
  spacer sequence
acucauuccuuggaacagau

SEQ ID NO: 11933 - RNA, 20 nt, Artificial Sequence
  spacer sequence
caaaccuuuuccacucauuc

SEQ ID NO: 11934 - RNA, 20 nt, Artificial Sequence
  spacer sequence
ggcaggucccaaaccuuuuc

SEQ ID NO: 11935 - RNA, 20 nt, Artificial Sequence
  spacer sequence
cagcucaugagaaggccacc

SEQ ID NO: 11936 - RNA, 20 nt, Artificial Sequence
  spacer sequence
ugagaaggccaccuccacua

SEQ ID NO: 11937 - RNA, 20 nt, Artificial Sequence
  spacer sequence
ugagcugggaaacucuggca

SEQ ID NO: 11938 - RNA, 20 nt, Artificial Sequence
  spacer sequence
caugagcugggaaacucugg

SEQ ID NO: 11939 - RNA, 20 nt, Artificial Sequence
  spacer sequence
acuagggagagcuuaggggg

SEQ ID NO: 11940 - RNA, 20 nt, Artificial Sequence
  spacer sequence
cuaguggagguggccuucuc

SEQ ID NO: 11941 - RNA, 20 nt, Artificial Sequence
  spacer sequence
agagugcacugcaacagagu

SEQ ID NO: 11942 - RNA, 20 nt, Artificial Sequence
  spacer sequence
ggagugcaguggcgcaaucu

SEQ ID NO: 11943 - RNA, 20 nt, Artificial Sequence
  spacer sequence
guugcagugcacucuggagu

SEQ ID NO: 11944 - RNA, 20 nt, Artificial Sequence
  spacer sequence
cucuguugcagugcacucug

SEQ ID NO: 11945 - RNA, 20 nt, Artificial Sequence
  spacer sequence
cacucuguugcagugcacuc

SEQ ID NO: 11946 - RNA, 20 nt, Artificial Sequence
  spacer sequence
gucucaaaaaaaaaaaaaaa

SEQ ID NO: 11947 - RNA, 20 nt, Artificial Sequence
  spacer sequence
caaaaaaaaaaaaaaaagca

SEQ ID NO: 11948 - RNA, 20 nt, Artificial Sequence
  spacer sequence
aaaaaaaaaaaaaaagcaaa

SEQ ID NO: 11949 - RNA, 20 nt, Artificial Sequence
  spacer sequence
uuuacgguuuuuuguuuguu

SEQ ID NO: 11950 - RNA, 20 nt, Artificial Sequence
  spacer sequence
aaaaagugaaaacaucugaa

SEQ ID NO: 11951 - RNA, 20 nt, Artificial Sequence
  spacer sequence
cuuuuuggaauauuugcaca

SEQ ID NO: 11952 - RNA, 20 nt, Artificial Sequence
  spacer sequence
gaaaucugagacauuucugg

SEQ ID NO: 11953 - RNA, 20 nt, Artificial Sequence
  spacer sequence
gauguuuucacuuuuuggaa

SEQ ID NO: 11954 - RNA, 20 nt, Artificial Sequence
  spacer sequence
gagacauuucuggucccagg

SEQ ID NO: 11955 - RNA, 20 nt, Artificial Sequence
  spacer sequence
gauuucagauguuuucacuu

SEQ ID NO: 11956 - RNA, 20 nt, Artificial Sequence
  spacer sequence
cagauuucagauguuuucac

SEQ ID NO: 11957 - RNA, 20 nt, Artificial Sequence
  spacer sequence
ggucccagguauuucacaca

SEQ ID NO: 11958 - RNA, 20 nt, Artificial Sequence
  spacer sequence
cagguauuucacacaagaga

SEQ ID NO: 11959 - RNA, 20 nt, Artificial Sequence
  spacer sequence
cacaagagauauucaaccug

SEQ ID NO: 11960 - RNA, 20 nt, Artificial Sequence
  spacer sequence
ugugugaaauaccugggacc

SEQ ID NO: 11961 - RNA, 20 nt, Artificial Sequence
  spacer sequence
cuugugugaaauaccuggga

SEQ ID NO: 11962 - RNA, 20 nt, Artificial Sequence
  spacer sequence
accuguauuauuaagcacau

SEQ ID NO: 11963 - RNA, 20 nt, Artificial Sequence
  spacer sequence
agcaugugcuuaauaauaca

SEQ ID NO: 11964 - RNA, 20 nt, Artificial Sequence
  spacer sequence
ugcuaagcccuuuucaugca

SEQ ID NO: 11965 - RNA, 20 nt, Artificial Sequence
  spacer sequence
ugcauuacacaugaaaccuc

SEQ ID NO: 11966 - RNA, 20 nt, Artificial Sequence
  spacer sequence
uguguaaugcaugaaaaggg

SEQ ID NO: 11967 - RNA, 20 nt, Artificial Sequence
  spacer sequence
caaccagccuuuacuguuaa

SEQ ID NO: 11968 - RNA, 20 nt, Artificial Sequence
  spacer sequence
cagaagaggaaccgaagcaa

SEQ ID NO: 11969 - RNA, 20 nt, Artificial Sequence
  spacer sequence
gugaaauuggcuuaacagua

SEQ ID NO: 11970 - RNA, 20 nt, Artificial Sequence
  spacer sequence
ucugugaaauuggcuuaaca

SEQ ID NO: 11971 - RNA, 20 nt, Artificial Sequence
  spacer sequence
ucuucugugaaauuggcuua

SEQ ID NO: 11972 - RNA, 20 nt, Artificial Sequence
  spacer sequence
guuccucuucugugaaauug

SEQ ID NO: 11973 - RNA, 20 nt, Artificial Sequence
  spacer sequence
uuugcuucgguuccucuucu

SEQ ID NO: 11974 - RNA, 20 nt, Artificial Sequence
  spacer sequence
uuccuuugcuucgguuccuc

SEQ ID NO: 11975 - RNA, 20 nt, Artificial Sequence
  spacer sequence
agaggaagcuuguccaacgc

SEQ ID NO: 11976 - RNA, 20 nt, Artificial Sequence
  spacer sequence
agaccauagccuaucuuucc

SEQ ID NO: 11977 - RNA, 20 nt, Artificial Sequence
  spacer sequence
ucuagaccauagccuaucuu

SEQ ID NO: 11978 - RNA, 20 nt, Artificial Sequence
  spacer sequence
aacgcacagccuguaggcug

SEQ ID NO: 11979 - RNA, 20 nt, Artificial Sequence
  spacer sequence
ugggccacaugcagccuaca

SEQ ID NO: 11980 - RNA, 20 nt, Artificial Sequence
  spacer sequence
aagcuguccugggccacaug

SEQ ID NO: 11981 - RNA, 20 nt, Artificial Sequence
  spacer sequence
uaaaacauuaugaguuuuuu

SEQ ID NO: 11982 - RNA, 20 nt, Artificial Sequence
  spacer sequence
uaauguuuuaagaaaguuug

SEQ ID NO: 11983 - RNA, 20 nt, Artificial Sequence
  spacer sequence
uguuuuagcucauuagcuau

SEQ ID NO: 11984 - RNA, 20 nt, Artificial Sequence
  spacer sequence
uuagcuaucauuaguguuag

SEQ ID NO: 11985 - RNA, 20 nt, Artificial Sequence
  spacer sequence
uuaguguuagcguguuuuau

SEQ ID NO: 11986 - RNA, 20 nt, Artificial Sequence
  spacer sequence
ugggccacacauaaaacacg

SEQ ID NO: 11987 - RNA, 20 nt, Artificial Sequence
  spacer sequence
ucuucccauguagcccaggg

SEQ ID NO: 11988 - RNA, 20 nt, Artificial Sequence
  spacer sequence
ucccauguagcccaggggaa

SEQ ID NO: 11989 - RNA, 20 nt, Artificial Sequence
  spacer sequence
cauguagcccaggggaacca

SEQ ID NO: 11990 - RNA, 20 nt, Artificial Sequence
  spacer sequence
ccugggcuacaugggaagaa

SEQ ID NO: 11991 - RNA, 20 nt, Artificial Sequence
  spacer sequence
uuugguuccccugggcuaca

SEQ ID NO: 11992 - RNA, 20 nt, Artificial Sequence
  spacer sequence
aaucuuuugguuccccuggg

SEQ ID NO: 11993 - RNA, 20 nt, Artificial Sequence
  spacer sequence
agagccucauuauuaagugg

SEQ ID NO: 11994 - RNA, 20 nt, Artificial Sequence
  spacer sequence
agaccaagguuguccaaucu

SEQ ID NO: 11995 - RNA, 20 nt, Artificial Sequence
  spacer sequence
uuauuaagugguggagauga

SEQ ID NO: 11996 - RNA, 20 nt, Artificial Sequence
  spacer sequence
accacuuaauaaugaggcuc

SEQ ID NO: 11997 - RNA, 20 nt, Artificial Sequence
  spacer sequence
ccaccacuuaauaaugaggc

SEQ ID NO: 11998 - RNA, 20 nt, Artificial Sequence
  spacer sequence
ucuccaccacuuaauaauga

SEQ ID NO: 11999 - RNA, 20 nt, Artificial Sequence
  spacer sequence
caucuccaccacuuaauaau

SEQ ID NO: 12000 - RNA, 20 nt, Artificial Sequence
  spacer sequence
aacccaggcaacccaggacc

SEQ ID NO: 12001 - RNA, 20 nt, Artificial Sequence
  spacer sequence
aaucucaucuccaccacuua

SEQ ID NO: 12002 - RNA, 20 nt, Artificial Sequence
  spacer sequence
uggguugccuggguucgaau

SEQ ID NO: 12003 - RNA, 20 nt, Artificial Sequence
  spacer sequence
ggcugguccuggguugccug

SEQ ID NO: 12004 - RNA, 20 nt, Artificial Sequence
  spacer sequence
caaucgcuaugucaugcuga

SEQ ID NO: 12005 - RNA, 20 nt, Artificial Sequence
  spacer sequence
aucgcuaugucaugcugacu

SEQ ID NO: 12006 - RNA, 20 nt, Artificial Sequence
  spacer sequence
cuaugucaugcugacuggaa

SEQ ID NO: 12007 - RNA, 20 nt, Artificial Sequence
  spacer sequence
ugcugacuggaagcacagca

SEQ ID NO: 12008 - RNA, 20 nt, Artificial Sequence
  spacer sequence
gcaugacauagcgauugaga

SEQ ID NO: 12009 - RNA, 20 nt, Artificial Sequence
  spacer sequence
agucagcaugacauagcgau

SEQ ID NO: 12010 - RNA, 20 nt, Artificial Sequence
  spacer sequence
caaaagguuuguuauuggcu

SEQ ID NO: 12011 - RNA, 20 nt, Artificial Sequence
  spacer sequence
aaagguuuguuauuggcuga

SEQ ID NO: 12012 - RNA, 20 nt, Artificial Sequence
  spacer sequence
gccaauaacaaaccuuuuga

SEQ ID NO: 12013 - RNA, 20 nt, Artificial Sequence
  spacer sequence
cagccaauaacaaaccuuuu

SEQ ID NO: 12014 - RNA, 20 nt, Artificial Sequence
  spacer sequence
ugacuuccccuagaauccca

SEQ ID NO: 12015 - RNA, 20 nt, Artificial Sequence
  spacer sequence
agaccucucagccaauaaca

SEQ ID NO: 12016 - RNA, 20 nt, Artificial Sequence
  spacer sequence
ccuagaaucccaggguugcu

SEQ ID NO: 12017 - RNA, 20 nt, Artificial Sequence
  spacer sequence
aggggaagucaagaccucuc

SEQ ID NO: 12018 - RNA, 20 nt, Artificial Sequence
  spacer sequence
caggguugcugacuuuguuu

SEQ ID NO: 12019 - RNA, 20 nt, Artificial Sequence
  spacer sequence
gcaacccugggauucuaggg

SEQ ID NO: 12020 - RNA, 20 nt, Artificial Sequence
  spacer sequence
cccgucagagccugccacag

SEQ ID NO: 12021 - RNA, 20 nt, Artificial Sequence
  spacer sequence
cgucagagccugccacagac

SEQ ID NO: 12022 - RNA, 20 nt, Artificial Sequence
  spacer sequence
gagccugccacagacuccuu

SEQ ID NO: 12023 - RNA, 20 nt, Artificial Sequence
  spacer sequence
gacgggagaaacaaagucag

SEQ ID NO: 12024 - RNA, 20 nt, Artificial Sequence
  spacer sequence
guggcaggcucugacgggag

SEQ ID NO: 12025 - RNA, 20 nt, Artificial Sequence
  spacer sequence
uuauuggauccgaguuggcc

SEQ ID NO: 12026 - RNA, 20 nt, Artificial Sequence
  spacer sequence
aauaaggagucuguggcagg

SEQ ID NO: 12027 - RNA, 20 nt, Artificial Sequence
  spacer sequence
gaguuggccagagacccuuc

SEQ ID NO: 12028 - RNA, 20 nt, Artificial Sequence
  spacer sequence
gauccaauaaggagucugug

SEQ ID NO: 12029 - RNA, 20 nt, Artificial Sequence
  spacer sequence
ggccaacucggauccaauaa

SEQ ID NO: 12030 - RNA, 20 nt, Artificial Sequence
  spacer sequence
cuggccaacucggauccaau

SEQ ID NO: 12031 - RNA, 20 nt, Artificial Sequence
  spacer sequence
gaccucauugaaucagcugg

SEQ ID NO: 12032 - RNA, 20 nt, Artificial Sequence
  spacer sequence
gaagggucucuggccaacuc

SEQ ID NO: 12033 - RNA, 20 nt, Artificial Sequence
  spacer sequence
uugaaucagcugggucacaa

SEQ ID NO: 12034 - RNA, 20 nt, Artificial Sequence
  spacer sequence
augaggucugaagggucucu

SEQ ID NO: 12035 - RNA, 20 nt, Artificial Sequence
  spacer sequence
gcugggucacaagugccaag

SEQ ID NO: 12036 - RNA, 20 nt, Artificial Sequence
  spacer sequence
caagugccaaguugcucgca

SEQ ID NO: 12037 - RNA, 20 nt, Artificial Sequence
  spacer sequence
cagugcagccuggaccggcu

SEQ ID NO: 12038 - RNA, 20 nt, Artificial Sequence
  spacer sequence
aggcugcacugcgagcaacu

SEQ ID NO: 12039 - RNA, 20 nt, Artificial Sequence
  spacer sequence
ggaacuucucauugucaaag

SEQ ID NO: 12040 - RNA, 20 nt, Artificial Sequence
  spacer sequence
agagccgguccaggcugcac

SEQ ID NO: 12041 - RNA, 20 nt, Artificial Sequence
  spacer sequence
cauugucaaagcuaagaguc

SEQ ID NO: 12042 - RNA, 20 nt, Artificial Sequence
  spacer sequence
uugucaaagcuaagagucaa

SEQ ID NO: 12043 - RNA, 20 nt, Artificial Sequence
  spacer sequence
aagcuaagagucaauugagu

SEQ ID NO: 12044 - RNA, 20 nt, Artificial Sequence
  spacer sequence
uagcuuugacaaugagaagu

SEQ ID NO: 12045 - RNA, 20 nt, Artificial Sequence
  spacer sequence
auugagucacccacugaguc

SEQ ID NO: 12046 - RNA, 20 nt, Artificial Sequence
  spacer sequence
auugacucuuagcuuugaca

SEQ ID NO: 12047 - RNA, 20 nt, Artificial Sequence
  spacer sequence
cccacugagucagauggcau

SEQ ID NO: 12048 - RNA, 20 nt, Artificial Sequence
  spacer sequence
gugggugacucaauugacuc

SEQ ID NO: 12049 - RNA, 20 nt, Artificial Sequence
  spacer sequence
gauggcauacucaaauguau

SEQ ID NO: 12050 - RNA, 20 nt, Artificial Sequence
  spacer sequence
gacucagugggugacucaau

SEQ ID NO: 12051 - RNA, 20 nt, Artificial Sequence
  spacer sequence
aauguauugcacaagucuaa

SEQ ID NO: 12052 - RNA, 20 nt, Artificial Sequence
  spacer sequence
aaaauccuguguaggcccac

SEQ ID NO: 12053 - RNA, 20 nt, Artificial Sequence
  spacer sequence
uguguaggcccacaaacauu

SEQ ID NO: 12054 - RNA, 20 nt, Artificial Sequence
  spacer sequence
ggugcaauguuugugggccu

SEQ ID NO: 12055 - RNA, 20 nt, Artificial Sequence
  spacer sequence
uagugauagggcauaccagg

SEQ ID NO: 12056 - RNA, 20 nt, Artificial Sequence
  spacer sequence
cuaggacucaggugcaaugu

SEQ ID NO: 12057 - RNA, 20 nt, Artificial Sequence
  spacer sequence
uuuuggagaaagagcccuag

SEQ ID NO: 12058 - RNA, 20 nt, Artificial Sequence
  spacer sequence
aaaaugaaaagcaaguugcu

SEQ ID NO: 12059 - RNA, 20 nt, Artificial Sequence
  spacer sequence
ccaaaaugaaaagcaaguug

SEQ ID NO: 12060 - RNA, 20 nt, Artificial Sequence
  spacer sequence
uucuccaaaaugaaaagcaa

SEQ ID NO: 12061 - RNA, 20 nt, Artificial Sequence
  spacer sequence
cccagaucauugaacaccuu

SEQ ID NO: 12062 - RNA, 20 nt, Artificial Sequence
  spacer sequence
gggggacuagggcucuuucu

SEQ ID NO: 12063 - RNA, 20 nt, Artificial Sequence
  spacer sequence
uugaacaccuucccccaccu

SEQ ID NO: 12064 - RNA, 20 nt, Artificial Sequence
  spacer sequence
augaucugggggacuagggc

SEQ ID NO: 12065 - RNA, 20 nt, Artificial Sequence
  spacer sequence
cccaccucugcuccaaaucc

SEQ ID NO: 12066 - RNA, 20 nt, Artificial Sequence
  spacer sequence
gcuccaaauccacuguccca

SEQ ID NO: 12067 - RNA, 20 nt, Artificial Sequence
  spacer sequence
aaauccacugucccaaaucu

SEQ ID NO: 12068 - RNA, 20 nt, Artificial Sequence
  spacer sequence
acugucccaaaucuucugua

SEQ ID NO: 12069 - RNA, 20 nt, Artificial Sequence
  spacer sequence
caaaucuucuguagcuuugg

SEQ ID NO: 12070 - RNA, 20 nt, Artificial Sequence
  spacer sequence
ucuguagcuuugggagauuu

SEQ ID NO: 12071 - RNA, 20 nt, Artificial Sequence
  spacer sequence
guagcuuugggagauuucuc

SEQ ID NO: 12072 - RNA, 20 nt, Artificial Sequence
  spacer sequence
caaagcuacagaagauuugg

SEQ ID NO: 12073 - RNA, 20 nt, Artificial Sequence
  spacer sequence
cccaaagcuacagaagauuu

SEQ ID NO: 12074 - RNA, 20 nt, Artificial Sequence
  spacer sequence
cuucuacccauuguugugaa

SEQ ID NO: 12075 - RNA, 20 nt, Artificial Sequence
  spacer sequence
ucuacccauuguugugaauu

SEQ ID NO: 12076 - RNA, 20 nt, Artificial Sequence
  spacer sequence
acccauuguugugaauuuuu

SEQ ID NO: 12077 - RNA, 20 nt, Artificial Sequence
  spacer sequence
caacaauggguagaagagaa

SEQ ID NO: 12078 - RNA, 20 nt, Artificial Sequence
  spacer sequence
uaaacuuaaucaguuacaug

SEQ ID NO: 12079 - RNA, 20 nt, Artificial Sequence
  spacer sequence
uuccccaagccccaucuggu

SEQ ID NO: 12080 - RNA, 20 nt, Artificial Sequence
  spacer sequence
ccaagccccaucugguuuuc

SEQ ID NO: 12081 - RNA, 20 nt, Artificial Sequence
  spacer sequence
gguuuucuucacuagucaaa

SEQ ID NO: 12082 - RNA, 20 nt, Artificial Sequence
  spacer sequence
ucacuagucaaacuagagag

SEQ ID NO: 12083 - RNA, 20 nt, Artificial Sequence
  spacer sequence
cuagucaaacuagagaguua

SEQ ID NO: 12084 - RNA, 20 nt, Artificial Sequence
  spacer sequence
aacuagagaguuaaaaggga

SEQ ID NO: 12085 - RNA, 20 nt, Artificial Sequence
  spacer sequence
aguuugacuagugaagaaaa

SEQ ID NO: 12086 - RNA, 20 nt, Artificial Sequence
  spacer sequence
cuaguuugacuagugaagaa

SEQ ID NO: 12087 - RNA, 20 nt, Artificial Sequence
  spacer sequence
cuuuuaacucucuaguuuga

SEQ ID NO: 12088 - RNA, 20 nt, Artificial Sequence
  spacer sequence
cauucccuuuuaacucucua

SEQ ID NO: 12089 - RNA, 20 nt, Artificial Sequence
  spacer sequence
ucaccucuggaucuuucaug

SEQ ID NO: 12090 - RNA, 20 nt, Artificial Sequence
  spacer sequence
ccucuggaucuuucaugucu

SEQ ID NO: 12091 - RNA, 20 nt, Artificial Sequence
  spacer sequence
ggaucuuucaugucuauuaa

SEQ ID NO: 12092 - RNA, 20 nt, Artificial Sequence
  spacer sequence
agaggugaugauugcuauca

SEQ ID NO: 12093 - RNA, 20 nt, Artificial Sequence
  spacer sequence
uaccuaacucaccauaaauc

SEQ ID NO: 12094 - RNA, 20 nt, Artificial Sequence
  spacer sequence
ccauaaaucccuucucugac

SEQ ID NO: 12095 - RNA, 20 nt, Artificial Sequence
  spacer sequence
cuucucugacuggugggcaa

SEQ ID NO: 12096 - RNA, 20 nt, Artificial Sequence
  spacer sequence
cugacuggugggcaacagug

SEQ ID NO: 12097 - RNA, 20 nt, Artificial Sequence
  spacer sequence
gacuggugggcaacaguggu

SEQ ID NO: 12098 - RNA, 20 nt, Artificial Sequence
  spacer sequence
gagaagggauuuauggugag

SEQ ID NO: 12099 - RNA, 20 nt, Artificial Sequence
  spacer sequence
agguccauaggaauuagcau

SEQ ID NO: 12100 - RNA, 20 nt, Artificial Sequence
  spacer sequence
auaggaauuagcauuaguaa

SEQ ID NO: 12101 - RNA, 20 nt, Artificial Sequence
  spacer sequence
uauggaccuggaauaccacu

SEQ ID NO: 12102 - RNA, 20 nt, Artificial Sequence
  spacer sequence
uaauguuuuaagaaaguuua

SEQ ID NO: 12103 - RNA, 20 nt, Artificial Sequence
  spacer sequence
uaaaacauuaugauauauau

SEQ ID NO: 12104 - RNA, 20 nt, Artificial Sequence
  spacer sequence
uaaacuuucuuaaaacauua

SEQ ID NO: 12105 - RNA, 20 nt, Artificial Sequence
  spacer sequence
aggccaaccugggccacaug

SEQ ID NO: 12106 - RNA, 20 nt, Artificial Sequence
  spacer sequence
cagguugcaaaggcuuaauu

SEQ ID NO: 12107 - RNA, 20 nt, Artificial Sequence
  spacer sequence
gguugcaaaggcuuaauuua

SEQ ID NO: 12108 - RNA, 20 nt, Artificial Sequence
  spacer sequence
aaauuaagccuuugcaaccu

SEQ ID NO: 12109 - RNA, 20 nt, Artificial Sequence
  spacer sequence
gugaucuuauuguaacauuc

SEQ ID NO: 12110 - RNA, 20 nt, Artificial Sequence
  spacer sequence
cagauacauacucuaaauua

SEQ ID NO: 12111 - RNA, 20 nt, Artificial Sequence
  spacer sequence
uauuguaacauucuucauca

SEQ ID NO: 12112 - RNA, 20 nt, Artificial Sequence
  spacer sequence
ucaucaagaauaccuggucu

SEQ ID NO: 12113 - RNA, 20 nt, Artificial Sequence
  spacer sequence
ucaagaauaccuggucuguu

SEQ ID NO: 12114 - RNA, 20 nt, Artificial Sequence
  spacer sequence
agaauaccuggucuguuuuc

SEQ ID NO: 12115 - RNA, 20 nt, Artificial Sequence
  spacer sequence
ugaugaagaauguuacaaua

SEQ ID NO: 12116 - RNA, 20 nt, Artificial Sequence
  spacer sequence
guuuucauucaagagccucu

SEQ ID NO: 12117 - RNA, 20 nt, Artificial Sequence
  spacer sequence
uucaagagccucugggucug

SEQ ID NO: 12118 - RNA, 20 nt, Artificial Sequence
  spacer sequence
agagccucugggucugugau

SEQ ID NO: 12119 - RNA, 20 nt, Artificial Sequence
  spacer sequence
ugaaugaaaacagaccaggu

SEQ ID NO: 12120 - RNA, 20 nt, Artificial Sequence
  spacer sequence
gggucugugauacaauucag

SEQ ID NO: 12121 - RNA, 20 nt, Artificial Sequence
  spacer sequence
gugauacaauucaggucuug

SEQ ID NO: 12122 - RNA, 20 nt, Artificial Sequence
  spacer sequence
cagacccagaggcucuugaa

SEQ ID NO: 12123 - RNA, 20 nt, Artificial Sequence
  spacer sequence
ggucuugaauugagaauguc

SEQ ID NO: 12124 - RNA, 20 nt, Artificial Sequence
  spacer sequence
ugaauugagaaugucuaucc

SEQ ID NO: 12125 - RNA, 20 nt, Artificial Sequence
  spacer sequence
agaccugaauuguaucacag

SEQ ID NO: 12126 - RNA, 20 nt, Artificial Sequence
  spacer sequence
auucaagaccugaauuguau

SEQ ID NO: 12127 - RNA, 20 nt, Artificial Sequence
  spacer sequence
caauucaagaccugaauugu

SEQ ID NO: 12128 - RNA, 20 nt, Artificial Sequence
  spacer sequence
aucccagaggcucgauccau

SEQ ID NO: 12129 - RNA, 20 nt, Artificial Sequence
  spacer sequence
cagaggcucgauccaugccu

SEQ ID NO: 12130 - RNA, 20 nt, Artificial Sequence
  spacer sequence
gggauagacauucucaauuc

SEQ ID NO: 12131 - RNA, 20 nt, Artificial Sequence
  spacer sequence
auccaugccucuuguuaauc

SEQ ID NO: 12132 - RNA, 20 nt, Artificial Sequence
  spacer sequence
agccucugggauagacauuc

SEQ ID NO: 12133 - RNA, 20 nt, Artificial Sequence
  spacer sequence
augccucuuguuaaucaggu

SEQ ID NO: 12134 - RNA, 20 nt, Artificial Sequence
  spacer sequence
uguuaaucaggucugagugg

SEQ ID NO: 12135 - RNA, 20 nt, Artificial Sequence
  spacer sequence
ggucugagugggcuccuuaa

SEQ ID NO: 12136 - RNA, 20 nt, Artificial Sequence
  spacer sequence
gagugggcuccuuaaugcuc

SEQ ID NO: 12137 - RNA, 20 nt, Artificial Sequence
  spacer sequence
gaccugauuaacaagaggca

SEQ ID NO: 12138 - RNA, 20 nt, Artificial Sequence
  spacer sequence
uuaaugcucuugguccuaga

SEQ ID NO: 12139 - RNA, 20 nt, Artificial Sequence
  spacer sequence
ugguccuagaaauuccuugg

SEQ ID NO: 12140 - RNA, 20 nt, Artificial Sequence
  spacer sequence
uagaaauuccuuggucaauu

SEQ ID NO: 12141 - RNA, 20 nt, Artificial Sequence
  spacer sequence
aggaccaagagcauuaagga

SEQ ID NO: 12142 - RNA, 20 nt, Artificial Sequence
  spacer sequence
uuggucaauuagcaugguga

SEQ ID NO: 12143 - RNA, 20 nt, Artificial Sequence
  spacer sequence
auuagcauggugaaagaccc

SEQ ID NO: 12144 - RNA, 20 nt, Artificial Sequence
  spacer sequence
ccaugcuaauugaccaagga

SEQ ID NO: 12145 - RNA, 20 nt, Artificial Sequence
  spacer sequence
uucaccaugcuaauugacca

SEQ ID NO: 12146 - RNA, 20 nt, Artificial Sequence
  spacer sequence
gccuagcaggggucuuucac

SEQ ID NO: 12147 - RNA, 20 nt, Artificial Sequence
  spacer sequence
aacugcucugccuagcaggg

SEQ ID NO: 12148 - RNA, 20 nt, Artificial Sequence
  spacer sequence
auucuggcccuacuuccuug

SEQ ID NO: 12149 - RNA, 20 nt, Artificial Sequence
  spacer sequence
ggcccuacuuccuugugcac

SEQ ID NO: 12150 - RNA, 20 nt, Artificial Sequence
  spacer sequence
uugugcacuagggggugguu

SEQ ID NO: 12151 - RNA, 20 nt, Artificial Sequence
  spacer sequence
ccaaaccacccccuagugca

SEQ ID NO: 12152 - RNA, 20 nt, Artificial Sequence
  spacer sequence
ccagccuauccccaaaccac

SEQ ID NO: 12153 - RNA, 20 nt, Artificial Sequence
  spacer sequence
guauuuauuuccccagccua

SEQ ID NO: 12154 - RNA, 20 nt, Artificial Sequence
  spacer sequence
ggaggugguuuggggauggu

SEQ ID NO: 12155 - RNA, 20 nt, Artificial Sequence
  spacer sequence
agauagcaaauacaaaucag

SEQ ID NO: 12156 - RNA, 20 nt, Artificial Sequence
  spacer sequence
ccaaaccaccuccagauagc

SEQ ID NO: 12157 - RNA, 20 nt, Artificial Sequence
  spacer sequence
aguuagccaaguguagguca

SEQ ID NO: 12158 - RNA, 20 nt, Artificial Sequence
  spacer sequence
cuuauccauagccuugcaac

SEQ ID NO: 12159 - RNA, 20 nt, Artificial Sequence
  spacer sequence
auagccuugcaacagaagag

SEQ ID NO: 12160 - RNA, 20 nt, Artificial Sequence
  spacer sequence
guugcaaggcuauggauaag

SEQ ID NO: 12161 - RNA, 20 nt, Artificial Sequence
  spacer sequence
ucuguugcaaggcuauggau

SEQ ID NO: 12162 - RNA, 20 nt, Artificial Sequence
  spacer sequence
ccaggcucuucuguugcaag

SEQ ID NO: 12163 - RNA, 20 nt, Artificial Sequence
  spacer sequence
caacuccccaggcucuucug

SEQ ID NO: 12164 - RNA, 20 nt, Artificial Sequence
  spacer sequence
cuguuucacaacuccccagg

SEQ ID NO: 12165 - RNA, 20 nt, Artificial Sequence
  spacer sequence
guuucaacugccggaaauag

SEQ ID NO: 12166 - RNA, 20 nt, Artificial Sequence
  spacer sequence
acugccggaaauagucugcc

SEQ ID NO: 12167 - RNA, 20 nt, Artificial Sequence
  spacer sequence
ggcaguugaaacugaaaauc

SEQ ID NO: 12168 - RNA, 20 nt, Artificial Sequence
  spacer sequence
gccuuucagcagaauuuaua

SEQ ID NO: 12169 - RNA, 20 nt, Artificial Sequence
  spacer sequence
gcagaauuuauaaucugggg

SEQ ID NO: 12170 - RNA, 20 nt, Artificial Sequence
  spacer sequence
gcugaaaggcagacuauuuc

SEQ ID NO: 12171 - RNA, 20 nt, Artificial Sequence
  spacer sequence
ggggaaauaaauucagauuu

SEQ ID NO: 12172 - RNA, 20 nt, Artificial Sequence
  spacer sequence
ccagauuauaaauucugcug

SEQ ID NO: 12173 - RNA, 20 nt, Artificial Sequence
  spacer sequence
gauuuucauuguaaacauag

SEQ ID NO: 12174 - RNA, 20 nt, Artificial Sequence
  spacer sequence
gaauuuauuuccccagauua

SEQ ID NO: 12175 - RNA, 20 nt, Artificial Sequence
  spacer sequence
uuguaaacauaggaagaagg

SEQ ID NO: 12176 - RNA, 20 nt, Artificial Sequence
  spacer sequence
uauguuuacaaugaaaaucu

SEQ ID NO: 12177 - RNA, 20 nt, Artificial Sequence
  spacer sequence
uccuauguuuacaaugaaaa

SEQ ID NO: 12178 - RNA, 20 nt, Artificial Sequence
  spacer sequence
gagguugcucagccaaaaau

SEQ ID NO: 12179 - RNA, 20 nt, Artificial Sequence
  spacer sequence
gaaccuucuuccuauguuua

SEQ ID NO: 12180 - RNA, 20 nt, Artificial Sequence
  spacer sequence
gccaaaaaugaugacaaaug

SEQ ID NO: 12181 - RNA, 20 nt, Artificial Sequence
  spacer sequence
uuuuuggcugagcaaccucu

SEQ ID NO: 12182 - RNA, 20 nt, Artificial Sequence
  spacer sequence
ucauuuuuggcugagcaacc

SEQ ID NO: 12183 - RNA, 20 nt, Artificial Sequence
  spacer sequence
acaauucaucucaccuucuu

SEQ ID NO: 12184 - RNA, 20 nt, Artificial Sequence
  spacer sequence
ucucaccuucuucugucauu

SEQ ID NO: 12185 - RNA, 20 nt, Artificial Sequence
  spacer sequence
caccuucuucugucauuuaa

SEQ ID NO: 12186 - RNA, 20 nt, Artificial Sequence
  spacer sequence
ccuucuucugucauuuaaca

SEQ ID NO: 12187 - RNA, 20 nt, Artificial Sequence
  spacer sequence
ucugucauuuaacaacugua

SEQ ID NO: 12188 - RNA, 20 nt, Artificial Sequence
  spacer sequence
gucauuuaacaacuguaagg

SEQ ID NO: 12189 - RNA, 20 nt, Artificial Sequence
  spacer sequence
uuuaacaacuguaagguuua

SEQ ID NO: 12190 - RNA, 20 nt, Artificial Sequence
  spacer sequence
aaaccuuacaguuguuaaau

SEQ ID NO: 12191 - RNA, 20 nt, Artificial Sequence
  spacer sequence
ucuaaaccuuacaguuguua

SEQ ID NO: 12192 - RNA, 20 nt, Artificial Sequence
  spacer sequence
cagcuucaaacguaguucau

SEQ ID NO: 12193 - RNA, 20 nt, Artificial Sequence
  spacer sequence
gcuucaaacguaguucaugu

SEQ ID NO: 12194 - RNA, 20 nt, Artificial Sequence
  spacer sequence
aacguaguucauguuuuauu

SEQ ID NO: 12195 - RNA, 20 nt, Artificial Sequence
  spacer sequence
uguuuuauucaaaccaaguu

SEQ ID NO: 12196 - RNA, 20 nt, Artificial Sequence
  spacer sequence
aaccaaguugaauaaugcaa

SEQ ID NO: 12197 - RNA, 20 nt, Artificial Sequence
  spacer sequence
acuugguuugaauaaaacau

SEQ ID NO: 12198 - RNA, 20 nt, Artificial Sequence
  spacer sequence
cuuugccagugacuuauuca

SEQ ID NO: 12199 - RNA, 20 nt, Artificial Sequence
  spacer sequence
uugccagugacuuauucaga

SEQ ID NO: 12200 - RNA, 20 nt, Artificial Sequence
  spacer sequence
cuggcaaagagaauugcauu

SEQ ID NO: 12201 - RNA, 20 nt, Artificial Sequence
  spacer sequence
gaaaaucagaccuaagcuag

SEQ ID NO: 12202 - RNA, 20 nt, Artificial Sequence
  spacer sequence
gaauaagucacuggcaaaga

SEQ ID NO: 12203 - RNA, 20 nt, Artificial Sequence
  spacer sequence
gaccuaagcuaguuaggcac

SEQ ID NO: 12204 - RNA, 20 nt, Artificial Sequence
  spacer sequence
gauuuucugaauaagucacu

SEQ ID NO: 12205 - RNA, 20 nt, Artificial Sequence
  spacer sequence
gaccucggggguugguucag

SEQ ID NO: 12206 - RNA, 20 nt, Artificial Sequence
  spacer sequence
gaggcaugccaugugccuaa

SEQ ID NO: 12207 - RNA, 20 nt, Artificial Sequence
  spacer sequence
gggguugguucaggagcuca

SEQ ID NO: 12208 - RNA, 20 nt, Artificial Sequence
  spacer sequence
ggagcucaggaguaggcauc

SEQ ID NO: 12209 - RNA, 20 nt, Artificial Sequence
  spacer sequence
ugaaccaacccccgagguca

SEQ ID NO: 12210 - RNA, 20 nt, Artificial Sequence
  spacer sequence
ggaguaggcaucugacacac

SEQ ID NO: 12211 - RNA, 20 nt, Artificial Sequence
  spacer sequence
ugagcuccugaaccaacccc

SEQ ID NO: 12212 - RNA, 20 nt, Artificial Sequence
  spacer sequence
gacacacuuuggucuaauga

SEQ ID NO: 12213 - RNA, 20 nt, Artificial Sequence
  spacer sequence
gaugccuacuccugagcucc

SEQ ID NO: 12214 - RNA, 20 nt, Artificial Sequence
  spacer sequence
aaugagaugcaagaugacau

SEQ ID NO: 12215 - RNA, 20 nt, Artificial Sequence
  spacer sequence
uuagaccaaagugugucaga

SEQ ID NO: 12216 - RNA, 20 nt, Artificial Sequence
  spacer sequence
cauuagaccaaaguguguca

SEQ ID NO: 12217 - RNA, 20 nt, Artificial Sequence
  spacer sequence
ugcaucucauuagaccaaag

SEQ ID NO: 12218 - RNA, 20 nt, Artificial Sequence
  spacer sequence
ucuugcaucucauuagacca

SEQ ID NO: 12219 - RNA, 20 nt, Artificial Sequence
  spacer sequence
gggagauucuggggaaaagu

SEQ ID NO: 12220 - RNA, 20 nt, Artificial Sequence
  spacer sequence
cagaacaugucaucuugcau

SEQ ID NO: 12221 - RNA, 20 nt, Artificial Sequence
  spacer sequence
cccagaacaugucaucuugc

SEQ ID NO: 12222 - RNA, 20 nt, Artificial Sequence
  spacer sequence
ggggaaaaguuucucauguu

SEQ ID NO: 12223 - RNA, 20 nt, Artificial Sequence
  spacer sequence
ccagaaucucccagaacaug

SEQ ID NO: 12224 - RNA, 20 nt, Artificial Sequence
  spacer sequence
cauguuccagagagccagag

SEQ ID NO: 12225 - RNA, 20 nt, Artificial Sequence
  spacer sequence
uguuccagagagccagagaa

SEQ ID NO: 12226 - RNA, 20 nt, Artificial Sequence
  spacer sequence
agagagccagagaaagacaa

SEQ ID NO: 12227 - RNA, 20 nt, Artificial Sequence
  spacer sequence
ggaacaugagaaacuuuucc

SEQ ID NO: 12228 - RNA, 20 nt, Artificial Sequence
  spacer sequence
cuggaacaugagaaacuuuu

SEQ ID NO: 12229 - RNA, 20 nt, Artificial Sequence
  spacer sequence
ggcucucuggaacaugagaa

SEQ ID NO: 12230 - RNA, 20 nt, Artificial Sequence
  spacer sequence
cuggcucucuggaacaugag

SEQ ID NO: 12231 - RNA, 20 nt, Artificial Sequence
  spacer sequence
uucucuggcucucuggaaca

SEQ ID NO: 12232 - RNA, 20 nt, Artificial Sequence
  spacer sequence
ucuguacuugaucccugcag

SEQ ID NO: 12233 - RNA, 20 nt, Artificial Sequence
  spacer sequence
guacuugaucccugcaggca

SEQ ID NO: 12234 - RNA, 20 nt, Artificial Sequence
  spacer sequence
aguacagaagauacuauugu

SEQ ID NO: 12235 - RNA, 20 nt, Artificial Sequence
  spacer sequence
cugcaggcaucuugauagca

SEQ ID NO: 12236 - RNA, 20 nt, Artificial Sequence
  spacer sequence
ugauagcaacauggagcucc

SEQ ID NO: 12237 - RNA, 20 nt, Artificial Sequence
  spacer sequence
agaugccugcagggaucaag

SEQ ID NO: 12238 - RNA, 20 nt, Artificial Sequence
  spacer sequence
auguugcuaucaagaugccu

SEQ ID NO: 12239 - RNA, 20 nt, Artificial Sequence
  spacer sequence
ugcaggacagcgggcagagc

SEQ ID NO: 12240 - RNA, 20 nt, Artificial Sequence
  spacer sequence
ugcaggagcuccauguugcu

SEQ ID NO: 12241 - RNA, 20 nt, Artificial Sequence
  spacer sequence
gcccgcuguccugcaggagc

SEQ ID NO: 12242 - RNA, 20 nt, Artificial Sequence
  spacer sequence
uagcucugcccgcuguccug

SEQ ID NO: 12243 - RNA, 20 nt, Artificial Sequence
  spacer sequence
cuuagcucugcccgcugucc

SEQ ID NO: 12244 - RNA, 20 nt, Artificial Sequence
  spacer sequence
uagaggaacugagcuggauc

SEQ ID NO: 12245 - RNA, 20 nt, Artificial Sequence
  spacer sequence
aggauucucuuagcucugcc

SEQ ID NO: 12246 - RNA, 20 nt, Artificial Sequence
  spacer sequence
ucuaggauucucuuagcucu

SEQ ID NO: 12247 - RNA, 20 nt, Artificial Sequence
  spacer sequence
guuccucuaggauucucuua

SEQ ID NO: 12248 - RNA, 20 nt, Artificial Sequence
  spacer sequence
agcucaguuccucuaggauu

SEQ ID NO: 12249 - RNA, 20 nt, Artificial Sequence
  spacer sequence
gcugggguuuauuuauguau

SEQ ID NO: 12250 - RNA, 20 nt, Artificial Sequence
  spacer sequence
aaaaaaauaaaauaaaauaa

SEQ ID NO: 12251 - RNA, 20 nt, Artificial Sequence
  spacer sequence
cuaaaaaaauaaaauaaaau

SEQ ID NO: 12252 - RNA, 20 nt, Artificial Sequence
  spacer sequence
cacucugcccaggcuggagu

SEQ ID NO: 12253 - RNA, 20 nt, Artificial Sequence
  spacer sequence
cucugcccaggcuggagugu

SEQ ID NO: 12254 - RNA, 20 nt, Artificial Sequence
  spacer sequence
gcccaggcuggaguguagug

SEQ ID NO: 12255 - RNA, 20 nt, Artificial Sequence
  spacer sequence
agccugggcagagugagacc

SEQ ID NO: 12256 - RNA, 20 nt, Artificial Sequence
  spacer sequence
acuacacuccagccugggca

SEQ ID NO: 12257 - RNA, 20 nt, Artificial Sequence
  spacer sequence
uagcucacugcagccccaaa

SEQ ID NO: 12258 - RNA, 20 nt, Artificial Sequence
  spacer sequence
cugcagccccaaacuccugg

SEQ ID NO: 12259 - RNA, 20 nt, Artificial Sequence
  spacer sequence
ugggcucaagcgacccucug

SEQ ID NO: 12260 - RNA, 20 nt, Artificial Sequence
  spacer sequence
agcgacccucuggccucagu

SEQ ID NO: 12261 - RNA, 20 nt, Artificial Sequence
  spacer sequence
cuugagcccaggaguuuggg

SEQ ID NO: 12262 - RNA, 20 nt, Artificial Sequence
  spacer sequence
ggccucaguccuuuccgccu

SEQ ID NO: 12263 - RNA, 20 nt, Artificial Sequence
  spacer sequence
guccuuuccgccucagccuc

SEQ ID NO: 12264 - RNA, 20 nt, Artificial Sequence
  spacer sequence
uuuccgccucagccuccgga

SEQ ID NO: 12265 - RNA, 20 nt, Artificial Sequence
  spacer sequence
gccucagccuccggaggaaa

SEQ ID NO: 12266 - RNA, 20 nt, Artificial Sequence
  spacer sequence
gccuccggaggaaaugagag

SEQ ID NO: 12267 - RNA, 20 nt, Artificial Sequence
  spacer sequence
ggaggaaaugagaguaaugg

SEQ ID NO: 12268 - RNA, 20 nt, Artificial Sequence
  spacer sequence
ggaggcugaggcggaaagga

SEQ ID NO: 12269 - RNA, 20 nt, Artificial Sequence
  spacer sequence
uccggaggcugaggcggaaa

SEQ ID NO: 12270 - RNA, 20 nt, Artificial Sequence
  spacer sequence
uuuccuccggaggcugaggc

SEQ ID NO: 12271 - RNA, 20 nt, Artificial Sequence
  spacer sequence
cauuuccuccggaggcugag

SEQ ID NO: 12272 - RNA, 20 nt, Artificial Sequence
  spacer sequence
cacucugcuaauuuuuuuau

SEQ ID NO: 12273 - RNA, 20 nt, Artificial Sequence
  spacer sequence
gcuaauuuuuuuauuuuuaa

SEQ ID NO: 12274 - RNA, 20 nt, Artificial Sequence
  spacer sequence
acaaaaaauuuaaaaauaaa

SEQ ID NO: 12275 - RNA, 20 nt, Artificial Sequence
  spacer sequence
cgcuuuacugcccagguugg

SEQ ID NO: 12276 - RNA, 20 nt, Artificial Sequence
  spacer sequence
cuuuacugcccagguugguc

SEQ ID NO: 12277 - RNA, 20 nt, Artificial Sequence
  spacer sequence
caaacuccuaagcuauccuc

SEQ ID NO: 12278 - RNA, 20 nt, Artificial Sequence
  spacer sequence
aacuccuaagcuauccuccu

SEQ ID NO: 12279 - RNA, 20 nt, Artificial Sequence
  spacer sequence
uaagcuauccuccugccuug

SEQ ID NO: 12280 - RNA, 20 nt, Artificial Sequence
  spacer sequence
uccugccuuggcuucccaaa

SEQ ID NO: 12281 - RNA, 20 nt, Artificial Sequence
  spacer sequence
ugccuuggcuucccaaagug

SEQ ID NO: 12282 - RNA, 20 nt, Artificial Sequence
  spacer sequence
caaagugaggggauuuacag

SEQ ID NO: 12283 - RNA, 20 nt, Artificial Sequence
  spacer sequence
cuuugggaagccaaggcagg

SEQ ID NO: 12284 - RNA, 20 nt, Artificial Sequence
  spacer sequence
ccucacuuugggaagccaag

SEQ ID NO: 12285 - RNA, 20 nt, Artificial Sequence
  spacer sequence
ugccuguaaauccccucacu

SEQ ID NO: 12286 - RNA, 20 nt, Artificial Sequence
  spacer sequence
gggugggguggcucaugccu

SEQ ID NO: 12287 - RNA, 20 nt, Artificial Sequence
  spacer sequence
agucugggugggguggcuca

SEQ ID NO: 12288 - RNA, 20 nt, Artificial Sequence
  spacer sequence
ucugguuuaaaccaacccug

SEQ ID NO: 12289 - RNA, 20 nt, Artificial Sequence
  spacer sequence
gguuuaaaccaacccugaag

SEQ ID NO: 12290 - RNA, 20 nt, Artificial Sequence
  spacer sequence
ggguugguuuaaaccagaag

SEQ ID NO: 12291 - RNA, 20 nt, Artificial Sequence
  spacer sequence
uucaagacucacuagauuua

SEQ ID NO: 12292 - RNA, 20 nt, Artificial Sequence
  spacer sequence
agacucacuagauuuacuuc

SEQ ID NO: 12293 - RNA, 20 nt, Artificial Sequence
  spacer sequence
ugaaggaaggcuucaggguu

SEQ ID NO: 12294 - RNA, 20 nt, Artificial Sequence
  spacer sequence
cuagauuuacuucuacacau

SEQ ID NO: 12295 - RNA, 20 nt, Artificial Sequence
  spacer sequence
agugagucuugaaggaaggc

SEQ ID NO: 12296 - RNA, 20 nt, Artificial Sequence
  spacer sequence
acacauuuccucauuguuua

SEQ ID NO: 12297 - RNA, 20 nt, Artificial Sequence
  spacer sequence
ucauuguuuaagccaguuug

SEQ ID NO: 12298 - RNA, 20 nt, Artificial Sequence
  spacer sequence
uuguuuaagccaguuugagu

SEQ ID NO: 12299 - RNA, 20 nt, Artificial Sequence
  spacer sequence
aacuggcuuaaacaaugagg

SEQ ID NO: 12300 - RNA, 20 nt, Artificial Sequence
  spacer sequence
aacucaaacuggcuuaaaca

SEQ ID NO: 12301 - RNA, 20 nt, Artificial Sequence
  spacer sequence
gguauuugugaucgaaagca

SEQ ID NO: 12302 - RNA, 20 nt, Artificial Sequence
  spacer sequence
caaauaccagaaaauccaac

SEQ ID NO: 12303 - RNA, 20 nt, Artificial Sequence
  spacer sequence
aaagcauccuaauuugauuc

SEQ ID NO: 12304 - RNA, 20 nt, Artificial Sequence
  spacer sequence
aucacaaauaccagaaaauc

SEQ ID NO: 12305 - RNA, 20 nt, Artificial Sequence
  spacer sequence
uaauuugauuccauauaaaa

SEQ ID NO: 12306 - RNA, 20 nt, Artificial Sequence
  spacer sequence
aauuaggaugcuuucgauca

SEQ ID NO: 12307 - RNA, 20 nt, Artificial Sequence
  spacer sequence
auauaaaaucgucuguguuu

SEQ ID NO: 12308 - RNA, 20 nt, Artificial Sequence
  spacer sequence
ucuguguuuacagcuccuag

SEQ ID NO: 12309 - RNA, 20 nt, Artificial Sequence
  spacer sequence
guguuuacagcuccuagugg

SEQ ID NO: 12310 - RNA, 20 nt, Artificial Sequence
  spacer sequence
uaguggcaucuuccagaacu

SEQ ID NO: 12311 - RNA, 20 nt, Artificial Sequence
  spacer sequence
uccagaacugguauuccuuu

SEQ ID NO: 12312 - RNA, 20 nt, Artificial Sequence
  spacer sequence
agaacugguauuccuuuaua

SEQ ID NO: 12313 - RNA, 20 nt, Artificial Sequence
  spacer sequence
ggaagaugccacuaggagcu

SEQ ID NO: 12314 - RNA, 20 nt, Artificial Sequence
  spacer sequence
uuuauaauaaucacuacugu

SEQ ID NO: 12315 - RNA, 20 nt, Artificial Sequence
  spacer sequence
cauuugagauaugcaggaac

SEQ ID NO: 12316 - RNA, 20 nt, Artificial Sequence
  spacer sequence
aaugugauuacguauuugaa

SEQ ID NO: 12317 - RNA, 20 nt, Artificial Sequence
  spacer sequence
caaaugugauuacguauuug

SEQ ID NO: 12318 - RNA, 20 nt, Artificial Sequence
  spacer sequence
ugcauaucucaaaugugauu

SEQ ID NO: 12319 - RNA, 20 nt, Artificial Sequence
  spacer sequence
guaguugggaaagagggcag

SEQ ID NO: 12320 - RNA, 20 nt, Artificial Sequence
  spacer sequence
caacuacagaguuccugcau

SEQ ID NO: 12321 - RNA, 20 nt, Artificial Sequence
  spacer sequence
uucccaacuacagaguuccu

SEQ ID NO: 12322 - RNA, 20 nt, Artificial Sequence
  spacer sequence
uaacacugcccucuuuccca

SEQ ID NO: 12323 - RNA, 20 nt, Artificial Sequence
  spacer sequence
caacuuugugucucaauuug

SEQ ID NO: 12324 - RNA, 20 nt, Artificial Sequence
  spacer sequence
caauuuguauggcuaguucg

SEQ ID NO: 12325 - RNA, 20 nt, Artificial Sequence
  spacer sequence
auuuguauggcuaguucgug

SEQ ID NO: 12326 - RNA, 20 nt, Artificial Sequence
  spacer sequence
aguccaaacacugcucauuu

SEQ ID NO: 12327 - RNA, 20 nt, Artificial Sequence
  spacer sequence
uggugcuuacuaagugcaaa

SEQ ID NO: 12328 - RNA, 20 nt, Artificial Sequence
  spacer sequence
uccccugcuacuacaucauc

SEQ ID NO: 12329 - RNA, 20 nt, Artificial Sequence
  spacer sequence
ccugcuacuacaucaucacc

SEQ ID NO: 12330 - RNA, 20 nt, Artificial Sequence
  spacer sequence
cugugugaaaaguaacaaca

SEQ ID NO: 12331 - RNA, 20 nt, Artificial Sequence
  spacer sequence
aaaucccugugugaaaagua

SEQ ID NO: 12332 - RNA, 20 nt, Artificial Sequence
  spacer sequence
ggguuggcagaauuauggcc

SEQ ID NO: 12333 - RNA, 20 nt, Artificial Sequence
  spacer sequence
gccaacccugaucuaaaucc

SEQ ID NO: 12334 - RNA, 20 nt, Artificial Sequence
  spacer sequence
agcccaccaucugcuuucau

SEQ ID NO: 12335 - RNA, 20 nt, Artificial Sequence
  spacer sequence
gcuuucauaaauaaaguuuu

SEQ ID NO: 12336 - RNA, 20 nt, Artificial Sequence
  spacer sequence
uaaauaaaguuuuauuggaa

SEQ ID NO: 12337 - RNA, 20 nt, Artificial Sequence
  spacer sequence
aauaaaacuuuauuuaugaa

SEQ ID NO: 12338 - RNA, 20 nt, Artificial Sequence
  spacer sequence
uuuacauauuuucauaugcu

SEQ ID NO: 12339 - RNA, 20 nt, Artificial Sequence
  spacer sequence
uaugcuaugauuggcagagu

SEQ ID NO: 12340 - RNA, 20 nt, Artificial Sequence
  spacer sequence
uggcucacugcaaccucugc

SEQ ID NO: 12341 - RNA, 20 nt, Artificial Sequence
  spacer sequence
cugcaaccucugccucccgg

SEQ ID NO: 12342 - RNA, 20 nt, Artificial Sequence
  spacer sequence
gccucccggguucaagugau

SEQ ID NO: 12343 - RNA, 20 nt, Artificial Sequence
  spacer sequence
cggguucaagugauccuccu

SEQ ID NO: 12344 - RNA, 20 nt, Artificial Sequence
  spacer sequence
agugauccuccugccucagc

SEQ ID NO: 12345 - RNA, 20 nt, Artificial Sequence
  spacer sequence
cuugaacccgggaggcagag

SEQ ID NO: 12346 - RNA, 20 nt, Artificial Sequence
  spacer sequence
uccugccucagccuccugag

SEQ ID NO: 12347 - RNA, 20 nt, Artificial Sequence
  spacer sequence
ugccucagccuccugaguag

SEQ ID NO: 12348 - RNA, 20 nt, Artificial Sequence
  spacer sequence
gccuccugaguagcugggac

SEQ ID NO: 12349 - RNA, 20 nt, Artificial Sequence
  spacer sequence
ugaguagcugggacuacagg

SEQ ID NO: 12350 - RNA, 20 nt, Artificial Sequence
  spacer sequence
ggaggcugaggcaggaggau

SEQ ID NO: 12351 - RNA, 20 nt, Artificial Sequence
  spacer sequence
cagcuacucaggaggcugag

SEQ ID NO: 12352 - RNA, 20 nt, Artificial Sequence
  spacer sequence
ugccuggcuaauuuuuguau

SEQ ID NO: 12353 - RNA, 20 nt, Artificial Sequence
  spacer sequence
cagcacucugggaggcugag

SEQ ID NO: 12354 - RNA, 20 nt, Artificial Sequence
  spacer sequence
auaaucccagcacucuggga

SEQ ID NO: 12355 - RNA, 20 nt, Artificial Sequence
  spacer sequence
cguccauaaucccagcacuc

SEQ ID NO: 12356 - RNA, 20 nt, Artificial Sequence
  spacer sequence
gcccuaagauacauauuuuu

SEQ ID NO: 12357 - RNA, 20 nt, Artificial Sequence
  spacer sequence
uagggcugaguacgguggcu

SEQ ID NO: 12358 - RNA, 20 nt, Artificial Sequence
  spacer sequence
aaaaaauauguaucuuaggg

SEQ ID NO: 12359 - RNA, 20 nt, Artificial Sequence
  spacer sequence
cuaaaaaauauguaucuuag

SEQ ID NO: 12360 - RNA, 20 nt, Artificial Sequence
  spacer sequence
aaguauuucucuaaaaaaua

SEQ ID NO: 12361 - RNA, 20 nt, Artificial Sequence
  spacer sequence
uguuugaggagggaaaugag

SEQ ID NO: 12362 - RNA, 20 nt, Artificial Sequence
  spacer sequence
aauuguaagucauguuugag

SEQ ID NO: 12363 - RNA, 20 nt, Artificial Sequence
  spacer sequence
cuaauuguaagucauguuug

SEQ ID NO: 12364 - RNA, 20 nt, Artificial Sequence
  spacer sequence
cuugcgaucaaaggagugau

SEQ ID NO: 12365 - RNA, 20 nt, Artificial Sequence
  spacer sequence
caagggacagucucuaauug

SEQ ID NO: 12366 - RNA, 20 nt, Artificial Sequence
  spacer sequence
aaggagugauuuauuucccc

SEQ ID NO: 12367 - RNA, 20 nt, Artificial Sequence
  spacer sequence
uuugaucgcaagggacaguc

SEQ ID NO: 12368 - RNA, 20 nt, Artificial Sequence
  spacer sequence
cuccuuugaucgcaagggac

SEQ ID NO: 12369 - RNA, 20 nt, Artificial Sequence
  spacer sequence
cccugagaucagaucaaagc

SEQ ID NO: 12370 - RNA, 20 nt, Artificial Sequence
  spacer sequence
gggggaaauaaaucacuccu

SEQ ID NO: 12371 - RNA, 20 nt, Artificial Sequence
  spacer sequence
cagggggaaauaaaucacuc

SEQ ID NO: 12372 - RNA, 20 nt, Artificial Sequence
  spacer sequence
gaucaaagccaguuuuggag

SEQ ID NO: 12373 - RNA, 20 nt, Artificial Sequence
  spacer sequence
gaucucagggggaaauaaau

SEQ ID NO: 12374 - RNA, 20 nt, Artificial Sequence
  spacer sequence
aagccaguuuuggagcgcua

SEQ ID NO: 12375 - RNA, 20 nt, Artificial Sequence
  spacer sequence
aaaacuggcuuugaucugau

SEQ ID NO: 12376 - RNA, 20 nt, Artificial Sequence
  spacer sequence
ugugcugucguccccccacc

SEQ ID NO: 12377 - RNA, 20 nt, Artificial Sequence
  spacer sequence
uccccccaccagcccccauc

SEQ ID NO: 12378 - RNA, 20 nt, Artificial Sequence
  spacer sequence
ccccaccagcccccaucacc

SEQ ID NO: 12379 - RNA, 20 nt, Artificial Sequence
  spacer sequence
aagauuaaggggggugacuu

SEQ ID NO: 12380 - RNA, 20 nt, Artificial Sequence
  spacer sequence
ccuaaguugaugagaaauuc

SEQ ID NO: 12381 - RNA, 20 nt, Artificial Sequence
  spacer sequence
uaaguugaugagaaauucca

SEQ ID NO: 12382 - RNA, 20 nt, Artificial Sequence
  spacer sequence
acuuaggagacaaauaucca

SEQ ID NO: 12383 - RNA, 20 nt, Artificial Sequence
  spacer sequence
ucaacuuaggagacaaauau

SEQ ID NO: 12384 - RNA, 20 nt, Artificial Sequence
  spacer sequence
caucaacuuaggagacaaau

SEQ ID NO: 12385 - RNA, 20 nt, Artificial Sequence
  spacer sequence
aggagaagaauugggaugga

SEQ ID NO: 12386 - RNA, 20 nt, Artificial Sequence
  spacer sequence
uggaauuucucaucaacuua

SEQ ID NO: 12387 - RNA, 20 nt, Artificial Sequence
  spacer sequence
ccuggaauuucucaucaacu

SEQ ID NO: 12388 - RNA, 20 nt, Artificial Sequence
  spacer sequence
ucuccuggaauuucucauca

SEQ ID NO: 12389 - RNA, 20 nt, Artificial Sequence
  spacer sequence
caauucuucuccuggaauuu

SEQ ID NO: 12390 - RNA, 20 nt, Artificial Sequence
  spacer sequence
aucccaauucuucuccugga

SEQ ID NO: 12391 - RNA, 20 nt, Artificial Sequence
  spacer sequence
gguccaucccaauucuucuc

SEQ ID NO: 12392 - RNA, 20 nt, Artificial Sequence
  spacer sequence
auuaugauuucuucccuggg

SEQ ID NO: 12393 - RNA, 20 nt, Artificial Sequence
  spacer sequence
uaauggauugggucuggucc

SEQ ID NO: 12394 - RNA, 20 nt, Artificial Sequence
  spacer sequence
ucccugggaaaacauuucag

SEQ ID NO: 12395 - RNA, 20 nt, Artificial Sequence
  spacer sequence
cugggaaaacauuucagagc

SEQ ID NO: 12396 - RNA, 20 nt, Artificial Sequence
  spacer sequence
cagggaagaaaucauaaugg

SEQ ID NO: 12397 - RNA, 20 nt, Artificial Sequence
  spacer sequence
gagcacaugacaagccccgc

SEQ ID NO: 12398 - RNA, 20 nt, Artificial Sequence
  spacer sequence
gaaauguuuucccagggaag

SEQ ID NO: 12399 - RNA, 20 nt, Artificial Sequence
  spacer sequence
ugugcucugaaauguuuucc

SEQ ID NO: 12400 - RNA, 20 nt, Artificial Sequence
  spacer sequence
cagggccucugccuauacag

SEQ ID NO: 12401 - RNA, 20 nt, Artificial Sequence
  spacer sequence
gggccucugccuauacagau

SEQ ID NO: 12402 - RNA, 20 nt, Artificial Sequence
  spacer sequence
gccuauacagaucacuuuga

SEQ ID NO: 12403 - RNA, 20 nt, Artificial Sequence
  spacer sequence
guauaggcagaggcccugag

SEQ ID NO: 12404 - RNA, 20 nt, Artificial Sequence
  spacer sequence
cuuugagcaauuugucuuua

SEQ ID NO: 12405 - RNA, 20 nt, Artificial Sequence
  spacer sequence
aagugaucuguauaggcaga

SEQ ID NO: 12406 - RNA, 20 nt, Artificial Sequence
  spacer sequence
uuaaagcuucuugaaaugau

SEQ ID NO: 12407 - RNA, 20 nt, Artificial Sequence
  spacer sequence
ugaaaugauccuaauauucu

SEQ ID NO: 12408 - RNA, 20 nt, Artificial Sequence
  spacer sequence
agaagcuuuaaagacaaauu

SEQ ID NO: 12409 - RNA, 20 nt, Artificial Sequence
  spacer sequence
uuucaagaagcuuuaaagac

SEQ ID NO: 12410 - RNA, 20 nt, Artificial Sequence
  spacer sequence
uaauauucuccuguaauucu

SEQ ID NO: 12411 - RNA, 20 nt, Artificial Sequence
  spacer sequence
ccuguaauucucacugcucu

SEQ ID NO: 12412 - RNA, 20 nt, Artificial Sequence
  spacer sequence
uguaauucucacugcucuaa

SEQ ID NO: 12413 - RNA, 20 nt, Artificial Sequence
  spacer sequence
ccucuagacauaauuccuau

SEQ ID NO: 12414 - RNA, 20 nt, Artificial Sequence
  spacer sequence
ucuagacauaauuccuauca

SEQ ID NO: 12415 - RNA, 20 nt, Artificial Sequence
  spacer sequence
agacauaauuccuaucauuu

SEQ ID NO: 12416 - RNA, 20 nt, Artificial Sequence
  spacer sequence
agaggagacagauucuuaga

SEQ ID NO: 12417 - RNA, 20 nt, Artificial Sequence
  spacer sequence
uaucauuuuauaaugcaaug

SEQ ID NO: 12418 - RNA, 20 nt, Artificial Sequence
  spacer sequence
uuuuauaaugcaaugauauu

SEQ ID NO: 12419 - RNA, 20 nt, Artificial Sequence
  spacer sequence
uugcauuauaaaaugauagg

SEQ ID NO: 12420 - RNA, 20 nt, Artificial Sequence
  spacer sequence
uuaauguauguuacuauuca

SEQ ID NO: 12421 - RNA, 20 nt, Artificial Sequence
  spacer sequence
gauugacagauuguauacuu

SEQ ID NO: 12422 - RNA, 20 nt, Artificial Sequence
  spacer sequence
gaauaguaacauacauuaag

SEQ ID NO: 12423 - RNA, 20 nt, Artificial Sequence
  spacer sequence
aucugaauaguaacauacau

SEQ ID NO: 12424 - RNA, 20 nt, Artificial Sequence
  spacer sequence
gucaaucugaauaguaacau

SEQ ID NO: 12425 - RNA, 20 nt, Artificial Sequence
  spacer sequence
uacauaauaaguauacaauc

SEQ ID NO: 12426 - RNA, 20 nt, Artificial Sequence
  spacer sequence
uugacuucuuuugcgaagug

SEQ ID NO: 12427 - RNA, 20 nt, Artificial Sequence
  spacer sequence
augaaaaugucauacauaau

SEQ ID NO: 12428 - RNA, 20 nt, Artificial Sequence
  spacer sequence
uuugcgaagugacauuauug

SEQ ID NO: 12429 - RNA, 20 nt, Artificial Sequence
  spacer sequence
caaaagaagucaaugaaaau

SEQ ID NO: 12430 - RNA, 20 nt, Artificial Sequence
  spacer sequence
cuucgcaaaagaagucaaug

SEQ ID NO: 12431 - RNA, 20 nt, Artificial Sequence
  spacer sequence
cagccugggaaagauuuaau

SEQ ID NO: 12432 - RNA, 20 nt, Artificial Sequence
  spacer sequence
caggcugggauggcaauaau

SEQ ID NO: 12433 - RNA, 20 nt, Artificial Sequence
  spacer sequence
uucccaggcugggauggcaa

SEQ ID NO: 12434 - RNA, 20 nt, Artificial Sequence
  spacer sequence
gguauuaaaucuuucccagg

SEQ ID NO: 12435 - RNA, 20 nt, Artificial Sequence
  spacer sequence
uccuccguccauuuaucaga

SEQ ID NO: 12436 - RNA, 20 nt, Artificial Sequence
  spacer sequence
uccguccauuuaucagaguc

SEQ ID NO: 12437 - RNA, 20 nt, Artificial Sequence
  spacer sequence
guccauuuaucagagucauu

SEQ ID NO: 12438 - RNA, 20 nt, Artificial Sequence
  spacer sequence
auuuaucagagucauucaga

SEQ ID NO: 12439 - RNA, 20 nt, Artificial Sequence
  spacer sequence
gagucauucagaacucccuc

SEQ ID NO: 12440 - RNA, 20 nt, Artificial Sequence
  spacer sequence
gauaaauggacggaggaaga

SEQ ID NO: 12441 - RNA, 20 nt, Artificial Sequence
  spacer sequence
uucagaacucccuccuuuuu

SEQ ID NO: 12442 - RNA, 20 nt, Artificial Sequence
  spacer sequence
gaacucccuccuuuuucccu

SEQ ID NO: 12443 - RNA, 20 nt, Artificial Sequence
  spacer sequence
gaaugacucugauaaaugga

SEQ ID NO: 12444 - RNA, 20 nt, Artificial Sequence
  spacer sequence
cuccuuuuucccucccgccu

SEQ ID NO: 12445 - RNA, 20 nt, Artificial Sequence
  spacer sequence
uuuuucccucccgccucaaa

SEQ ID NO: 12446 - RNA, 20 nt, Artificial Sequence
  spacer sequence
cucccgccucaaaguauaaa

SEQ ID NO: 12447 - RNA, 20 nt, Artificial Sequence
  spacer sequence
cgccucaaaguauaaauuaa

SEQ ID NO: 12448 - RNA, 20 nt, Artificial Sequence
  spacer sequence
aaguauaaauuaaaauauuu

SEQ ID NO: 12449 - RNA, 20 nt, Artificial Sequence
  spacer sequence
uucaaacauauuuccuugga

SEQ ID NO: 12450 - RNA, 20 nt, Artificial Sequence
  spacer sequence
aacauauuuccuuggauauu

SEQ ID NO: 12451 - RNA, 20 nt, Artificial Sequence
  spacer sequence
uuggauauuuuucucuagua

SEQ ID NO: 12452 - RNA, 20 nt, Artificial Sequence
  spacer sequence
aaggaaauauguuugaaaga

SEQ ID NO: 12453 - RNA, 20 nt, Artificial Sequence
  spacer sequence
cuaguaaucacuuuguuaaa

SEQ ID NO: 12454 - RNA, 20 nt, Artificial Sequence
  spacer sequence
aguaaucacuuuguuaaaga

SEQ ID NO: 12455 - RNA, 20 nt, Artificial Sequence
  spacer sequence
cuuuguuaaagagauauuac

SEQ ID NO: 12456 - RNA, 20 nt, Artificial Sequence
  spacer sequence
uuaacaaagugauuacuaga

SEQ ID NO: 12457 - RNA, 20 nt, Artificial Sequence
  spacer sequence
cuuuaacaaagugauuacua

SEQ ID NO: 12458 - RNA, 20 nt, Artificial Sequence
  spacer sequence
uuuagguaguaauaucucuu

SEQ ID NO: 12459 - RNA, 20 nt, Artificial Sequence
  spacer sequence
cguucccagucccugucugc

SEQ ID NO: 12460 - RNA, 20 nt, Artificial Sequence
  spacer sequence
cagucccugucugcauccug

SEQ ID NO: 12461 - RNA, 20 nt, Artificial Sequence
  spacer sequence
cugucugcauccugauuuau

SEQ ID NO: 12462 - RNA, 20 nt, Artificial Sequence
  spacer sequence
gcauccugauuuaucgagau

SEQ ID NO: 12463 - RNA, 20 nt, Artificial Sequence
  spacer sequence
ugauuuaucgagauagcuua

SEQ ID NO: 12464 - RNA, 20 nt, Artificial Sequence
  spacer sequence
ggaugcagacagggacuggg

SEQ ID NO: 12465 - RNA, 20 nt, Artificial Sequence
  spacer sequence
agauagcuuauaggcauuuu

SEQ ID NO: 12466 - RNA, 20 nt, Artificial Sequence
  spacer sequence
auaaaucaggaugcagacag

SEQ ID NO: 12467 - RNA, 20 nt, Artificial Sequence
  spacer sequence
cgauaaaucaggaugcagac

SEQ ID NO: 12468 - RNA, 20 nt, Artificial Sequence
  spacer sequence
acuaccaaaugagaaaugau

SEQ ID NO: 12469 - RNA, 20 nt, Artificial Sequence
  spacer sequence
uuugguaguugaagaaaguu

SEQ ID NO: 12470 - RNA, 20 nt, Artificial Sequence
  spacer sequence
cauuugguaguugaagaaag

SEQ ID NO: 12471 - RNA, 20 nt, Artificial Sequence
  spacer sequence
uuucucauuugguaguugaa

SEQ ID NO: 12472 - RNA, 20 nt, Artificial Sequence
  spacer sequence
gagguggguuuuccaaauuu

SEQ ID NO: 12473 - RNA, 20 nt, Artificial Sequence
  spacer sequence
gaucauuucucauuugguag

SEQ ID NO: 12474 - RNA, 20 nt, Artificial Sequence
  spacer sequence
aaauuuuuauggccugcaug

SEQ ID NO: 12475 - RNA, 20 nt, Artificial Sequence
  spacer sequence
gucacauccacaaaccaucu

SEQ ID NO: 12476 - RNA, 20 nt, Artificial Sequence
  spacer sequence
cauccacaaaccaucuguac

SEQ ID NO: 12477 - RNA, 20 nt, Artificial Sequence
  spacer sequence
acaaaccaucuguacuauua

SEQ ID NO: 12478 - RNA, 20 nt, Artificial Sequence
  spacer sequence
guacuauuacuaauuuaucu

SEQ ID NO: 12479 - RNA, 20 nt, Artificial Sequence
  spacer sequence
uaaauggagaaacuuuuuuu

SEQ ID NO: 12480 - RNA, 20 nt, Artificial Sequence
  spacer sequence
auuuaagauaaauuaguaau

SEQ ID NO: 12481 - RNA, 20 nt, Artificial Sequence
  spacer sequence
ccauuuaagauaaauuagua

SEQ ID NO: 12482 - RNA, 20 nt, Artificial Sequence
  spacer sequence
uuuuuuuuuuuuuucacuuu

SEQ ID NO: 12483 - RNA, 20 nt, Artificial Sequence
  spacer sequence
cuuuuauggaagagauacau

SEQ ID NO: 12484 - RNA, 20 nt, Artificial Sequence
  spacer sequence
auaaaagugaaaaaaaaaaa

SEQ ID NO: 12485 - RNA, 20 nt, Artificial Sequence
  spacer sequence
uccauaaaagugaaaaaaaa

SEQ ID NO: 12486 - RNA, 20 nt, Artificial Sequence
  spacer sequence
cuuccauaaaagugaaaaaa

SEQ ID NO: 12487 - RNA, 20 nt, Artificial Sequence
  spacer sequence
guaaccuuugcccuauguau

SEQ ID NO: 12488 - RNA, 20 nt, Artificial Sequence
  spacer sequence
cccuucuguaaccuuugccc

SEQ ID NO: 12489 - RNA, 20 nt, Artificial Sequence
  spacer sequence
gugucccccuucuguaaccu

SEQ ID NO: 12490 - RNA, 20 nt, Artificial Sequence
  spacer sequence
aagaccuuucuagguacacc

SEQ ID NO: 12491 - RNA, 20 nt, Artificial Sequence
  spacer sequence
uggaagcucugugucccccu

SEQ ID NO: 12492 - RNA, 20 nt, Artificial Sequence
  spacer sequence
agguacaccacccucccggc

SEQ ID NO: 12493 - RNA, 20 nt, Artificial Sequence
  spacer sequence
cggcaucucauauucaccaa

SEQ ID NO: 12494 - RNA, 20 nt, Artificial Sequence
  spacer sequence
cauauucaccaaucuggaag

SEQ ID NO: 12495 - RNA, 20 nt, Artificial Sequence
  spacer sequence
uauucaccaaucuggaaguu

SEQ ID NO: 12496 - protein, 57 aa, Unknown
  chloroplast transit peptide
MASSVLSSAAVATRSNVAQANMVAPFTGLKSAASFPVSRKQNLDITSIASNGGRVQC

What is claimed is:

1. A composition comprising a CasX variant protein comprising the sequence of SEQ ID NO: 126, or a sequence having at least 90% sequence identity thereto, and a first guide ribonucleic acid (gRNA), wherein the CasX variant protein is a chimeric CasX protein comprising protein domains from two or more different CasX proteins, and wherein the gRNA comprises a targeting sequence complementary to a superoxide dismutase 1 (SOD1) gene target nucleic acid sequence comprising one or more mutations.

2. The composition of claim 1, wherein the one or more mutations are in a region selected from the group consisting of:
   a) a SOD1 intron;
   b) a SOD1 exon;
   c) a SOD1 intron-exon junction;
   d) a SOD1 regulatory element; and
   e) an intergenic region.

3. The composition of claim 1, wherein the one or more mutations comprise an insertion, deletion, substitution, duplication, or inversion of one or more nucleotides as compared to a wild-type SOD1 gene sequence.

4. The composition of claim 3, wherein the one or more mutations comprise a gain of function mutation.

5. The composition of claim 1, wherein the one or more mutations in the SOD1 gene target nucleic acid sequence encode a mutation selected from the group consisting of A4S, A4T, A4V, C6F, V7E, L8Q, L8V, G12R, V14G, V14M, G16S, F20C, E21G, E21K, Q22L, G37R, L38R, L38V, G41D, G41S, H43R, F45C, H46R, H48Q, H48R, E49K, T54R, N65S, L67P, L67R, G72S, D76Y, H80A, L84F, L84V, G85R, N86S, V87A, A89T, A89V, D90A, D90V, G93A, G93C, G93D, G93R, G93V, A95G, V97M, E100G, E100K, D101G, D101N, I104F, S105L, L106V, G108V, C111Y, I112M, I112T, I113T, G114A, R115G, V118L, D124G, D124V, D125H, L126S, S134N, N139K, L144F, L144S, A145T, C146R, G147R, V148G, V148 I, I149T, and I151T relative to the wild-type superoxide dismutase 1 protein sequence of SEQ ID NO: 100 without the N-terminal methionine.

6. The composition of claim 1, wherein the SOD1 gene encodes a protein comprising an A4V substitution, a D90A substitution or a G93A substitution compared to the wild-type superoxide dismutase 1 protein sequence of SEQ ID NO: 100 without the N-terminal methionine.

7. The composition of claim 1, wherein the SOD1 gene encodes a non-functional superoxide dismutase 1 protein.

8. The composition of claim 1, wherein the gRNA is a single-molecule gRNA (sgRNA).

9. The composition of claim 1, wherein the targeting sequence of the gRNA comprises a ribonucleic acid (RNA) sequence selected from the group consisting of the sequences of SEQ ID NOS: 351-357, 370, and 371, or a sequence having at least 90% identity thereto.

10. The composition of claim 1, wherein the targeting sequence of the gRNA is complementary to a sequence of a SOD1 exon, to a sequence of a SOD1 intron, to a sequence of a SOD1 intron-exon junction, to a sequence of a SOD1 regulatory element, to a sequence of a sequence of an intergenic region of the SOD1 gene or to a sequence comprising one or more single nucleotide polymorphisms (SNPs) of the SOD1 gene.

11. The composition of claim 1, wherein the targeting sequence of the gRNA is complementary to a sequence of a SOD1 exon 1 or complementary to a target nucleic acid sequence encoding a A4V substitution, a D90A substitution or a G93A substitution compared to the wild-type superoxide dismutase 1 protein sequence of SEQ ID NO: 100 without the N-terminal methionine.

12. The composition of claim 1, further comprising a second gRNA, wherein the second gRNA has a targeting sequence complementary to a different or overlapping portion of the SOD1 target nucleic acid compared to the targeting sequence of the first gRNA.

13. The composition of claim 12, wherein the first or second gRNA has a scaffold comprising the sequence of SEQ ID NO: 2238, or a sequence having at least 70% identity thereto.

14. The composition of claim 1, wherein the CasX variant protein further comprises one or more nuclear localization signals (NLS).

15. The composition of claim 1, further comprising a donor template nucleic acid.

16. The composition of claim 1, wherein the chimeric CasX protein comprising protein domains from two or more different CasX proteins, comprises proteins domains from two or more different reference CasX proteins.

17. The composition of claim 1, wherein the chimeric CasX protein comprising protein domains from two or more different CasX proteins, comprises proteins domains from two or more different CasX variant proteins.

18. A composition comprising a CasX variant protein comprising the sequence of SEQ ID NO: 126, or a sequence having at least 90% sequence identity thereto, and a first guide ribonucleic acid (gRNA), wherein the gRNA has a scaffold comprising a sequence having at least 70% sequence identity to the sequence of SEQ ID NO: 2238, and wherein the gRNA comprises a targeting sequence complementary to a superoxide dismutase 1 (SOD1) gene target nucleic acid sequence comprising one or more mutations.

19. The composition of claim 18, wherein the SOD1 gene comprises one or more mutations in a region selected from the group consisting of:

a) a SOD1 intron;
b) a SOD1 exon;
c) a SOD1 intron-exon junction;
d) a SOD1 regulatory element; and
e) an intergenic region.

20. The composition of claim 18, wherein the SOD1 gene comprising a mutation encodes a protein comprising a A4V substitution, a D90A substitution, or a G93A substitution compared to the wild-type superoxide dismutase 1 protein sequence of SEQ ID NO: 100 without the N-terminal methionine.

21. The composition of claim 18, wherein the targeting sequence of the gRNA comprises a sequence selected from the group consisting of the sequences of SEQ ID NOS: 351-357, 370, and 371, or a sequence having at least 90% identity thereto.

22. A nucleic acid vector:
(a) encoding a CasX variant protein, the CasX variant protein comprising the sequence of SEQ ID NO: 126, or a sequence having at least 90% sequence identity thereto; and
(b) encoding a guide ribonucleic acid (gRNA), wherein the gRNA has a scaffold comprising a sequence having at least 70% sequence identity to the sequence of SEQ ID NO: 2238, and wherein the gRNA comprises a targeting sequence complementary to a superoxide dismutase 1 (SOD1) gene target nucleic acid sequence comprising one or more mutations.

23. The nucleic acid vector of claim 22, wherein the targeting sequence of the gRNA comprises a ribonucleic acid sequence selected from the group consisting of the sequences of SEQ ID NOS: 351-357, 370, and 371, or a sequence having at least 90% identity thereto.

24. The nucleic acid vector of claim 22, wherein the nucleic acid vector is as an adeno-associated viral (AAV) vector.

25. A composition comprising:
(a) a CasX variant protein, or a sequence encoding the CasX variant protein, the CasX variant protein comprising the sequence of SEQ ID NO: 126, or a sequence having at least 90% sequence identity thereto; and
(b) a guide ribonucleic acid (gRNA), wherein the gRNA has a scaffold comprising a sequence having at least 70% sequence identity to the sequence of SEQ ID NO: 2238, and wherein the gRNA comprises a targeting sequence complementary to a superoxide dismutase 1 (SOD1) gene target nucleic acid sequence comprising one or more mutations.

* * * * *